United States Patent 7,560,542 (NUCLEIC ACID MOLECULE SEQ ID NO. 68811 AND OTHER MOLECULES ASSOCIATED WITH PLANTS) - sequence listing, part 13

SEQ ID NO: 77988 - DNA, 429 bp, Zea mays
  Clone ID: LIB3079-012-Q1-K1-C12
ctcaaaggcagataaaccaaaattcttgtcttttgatgatgaacttgtgcagggggctgggcctccaactattgcaagaggagccctcacagaaattgcttccaggcttagaactaggactttgagagatacaagtaccgacaataatcctccaccttttgccccttttgatgatcctcctgttgatatgcctagcagaaagttgccactatatggagggcctgccactgatccaccgtatggaaggcctgccaatgatccactgtatggaaggcctgccatagatccaccattcggaagacctaccaatgatcgaccatatggaaggactgctgttgctcctccattttgaagacctgccaacgatccaccatatggaaggcctaccaacgatccaccatatggacgaccttccggtagtataccata

SEQ ID NO: 77989 - DNA, 262 bp, Zea mays
  Clone ID: LIB3079-012-Q1-K1-C2
gacactccgtagtctgtaccccaagcaccggcgcggcggcggcggctaccatggcggtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagc

SEQ ID NO: 77990 - DNA, 346 bp, Zea mays
  Clone ID: LIB3079-012-Q1-K1-C3
ttcatactccagtacaattgagaagacatccccatccccatcttcatctgcagcaagggggtctagggtcttttatggaagcagggccttcttttaagtttctaatgcaaagtagtacactagctcgttactatctcctacatacatatacatggttccaggtttatcagatatcttctggcatgtaatcacatactttctgtctccataatatgcttctaggactcactcctggtattgctattagtgttatgctttgttagaagataataatttcatctcatagtaatcccatgtactaatacatacccatgaaatataatgtcatgaaatcagttctgactcg

SEQ ID NO: 77991 - DNA, 215 bp, Zea mays
  unsure at all n locations
  Clone ID: LIB3079-012-Q1-K1-C4
cagaattattattatttaaaaaagcaagagtcaaatactagcacaatccattacatgacggactgtantgcgcccatgtatatatatggtactagtactgatacaataacagtacgtagcctctattcggctcatgttcattgacatggcttattctagtcccactgaaaccatacgcacacgggtgggcccgaactacgttctacgtcaattac

SEQ ID NO: 77992 - DNA, 388 bp, Zea mays
  Clone ID: LIB3079-012-Q1-K1-C5
gtaaagaattctccactctcttgacttgacgaggctatataaccagaggccgtcaggggagaactgaagactgagagcattctctgcttataatctttattcctctatattctaaattatttttttcaatccccttccacctggattcgattcgaatcccacaccaccacgtggtgttcttcctatatcgaataaacgttgtttcgcttgtctaatgatcgatagggcactgaaagagtcattcctagagactctacggaaggacacaacggagatggagcagcctgcttgagaagaggcggcggatgagaaagaagcgctcaacctaaactcgtggtcgtcgaccagcatgcgccttgacgtccctctttttgattcatttatttga

SEQ ID NO: 77993 - DNA, 343 bp, Zea mays
  Clone ID: LIB3079-012-Q1-K1-C6
cgaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctactcaccaagtgcgccgtcacctgcaagaactgcgtccccgtgtccacggacaaaggggccatcaagtacaggtgccgggacttgctcccacaaaactgcgggtgcaagatccactagagac

SEQ ID NO: 77994 - DNA, 300 bp, Zea mays
  Clone ID: LIB3079-012-Q1-K1-C7
aattgatagccaccagcttgtatgcaagcttgccatagatgggaagaaggggaaggaggggcaatcacagcaatctggacctggcaaccagcagcagcaacagcaacagcagatgctgccgggtggtccgcaggaaattcagggaggcctgggccttggttcacaaatgggagcacagtatggtggccctgggagtggtatgccttcgtttggtttaggtggcgttggcggtgggtttgggggtccaaacccttatgctaacatgccatcttccatgggtggaggatgcgcaagtgggtt

SEQ ID NO: 77995 - DNA, 315 bp, Zea mays
  Clone ID: LIB3079-012-Q1-K1-C8
cggacgcgtgggtgcggaactcagacctctaagaagggtcatctttaatgcggtgggcaaccgcaaactggcaagcatgaaagcaggctactcgcacaaaaccgcttcacctttcgcggacatgctggcttttcgcaaggtcaaggcaaggcttggaggtcgtcttcgcttactgatttcaggaggggctccgttgagtaatgagatcgaagagttcatgagagtgaccacctgtgcatacttcatccaaggctatggtttaacagaaacactgggacctagcactgtctgctacatcgacgacatggccctggt

SEQ ID NO: 77996 - DNA, 433 bp, Zea mays
  Clone ID: LIB3079-012-Q1-K1-C9
agcgaaacttctggaaactttgaatttgcacttttgactatcctcagatgcgcggaaaagccagcaaagtattttgctaagctcttacgaaaggccatgaaaggtttaggcactgatgacatgacacttataagggtggtggtgacgaggaccgagattgacatgcaatatatcaaggcagagtacttgaagaagtacaagaagccattagctgaggctatcaactccgagacatcaggaaactatcggacgttccttctttcacttgttggtcatggccattaggctatgtttcgaccatgggacatgatatttctatcgatccaccctaaatgcagcgacctacctggaaaacttatgatgttgccatttatctgtcgtgactcctggatctaactgccacatatcacatatgcggttcctagtatgcttg

SEQ ID NO: 77997 - DNA, 427 bp, Zea mays
  Clone ID: LIB3079-012-Q1-K1-D1
gcgcggtcgggtcagttgccaccggccctgccacgacgagaccaccacggcactgaggtgagctatatccatacgtccgctagtgaatactagtgtgctagggaacgaatagaagacgcaatgaaaccagtaaaagaaaagcttgtgttgtcctgtcgtggcagggccggtggcggtgagcgggcccggacctccctgctttctggggcctgccggtcgggtcagttgccggaaatgcccccgtggtagactagtagactgtagaccggagcaaaatcttggacttgacgatggcgtggaagaacaccaagaaatcaaccccacagctgctttgttgtcgggtcgggtcggatccatctgcgggtactacctgcgtccagctattcatatgtacgtgtacaggtttatttatttacatacaacattt

SEQ ID NO: 77998 - DNA, 264 bp, Zea mays
  Clone ID: LIB3079-012-Q1-K1-D10
gtttccttggtgcagggagggtttctataccatgtcgcggtgtcggttgtgtgagctcgtgcccccccttgtagatagtactctgctatctcgtcgtgatcgtgagtggtgattctgtctggttgatatttgctactgatattggtcccatttgagatatgcgttgctgctaaaaaaaaaaaaaaaaaaaaaaaaaaataagaaagaaaaaaaaaaatataagagcatactgaaaaaaaagatgaaaagatctaaaactgcttt

SEQ ID NO: 77999 - DNA, 326 bp, Zea mays
  Clone ID: LIB3079-012-Q1-K1-D11
cccacgcgtccggtacgaactcgcagatcagagagaccgaggcgcccgcggtggtgcttgccttccttgccccgttcacgagagaattttctggagtcttcgactcgagcagggttccgatggcgctgcaatggatgatcctggcgtgcgtggtggcggtggaagctgcggtggctgcgctggtcacgctcccggtgccccgcgctgtgcggggccagatcgtcgcgctcacgtccttgttcctgcagcccctgtccagtgtgatacccttcgccgccgttcagatcctcgatctctactggaagatggagcacagactgatgtgc

SEQ ID NO: 78000 - DNA, 369 bp, Zea mays
  Clone ID: LIB3079-012-Q1-K1-D12
aaaaaaaaaaaaaaaaaaaaaaattaaaaaaaaaaaaaaaaaaaaaaaaaaatagggaaaagaaaaaataaaaaaaaaaaaaaaaaaaaaaaaaaaaaaaaaaaaaaataaaaaaaaaataaaaaaaaaaaaaaaaagtgtgatatctttttagagtttcaatgttttaatgatgttaaatataaactaatcactttttatttgcgtaactaaatttaaattaatttgcggttgtttaaaaaatttgttaattggaaaaactttgagtttacaaaatttaaccgcttttaaaaaattccatttttactgaattgaggtattaagaaaaatgcccaaattgttgacttttacaaaaatttgaccaattta

SEQ ID NO: 78001 - DNA, 276 bp, Zea mays
  Clone ID: LIB3079-012-Q1-K1-D2
gagcttccagctctactctgatatctgcgaggtgctggcggtgctgctggacaggggctgtgacatggagtatgcggaatgcgtgaaggcttttgaggcatatgctagtgctgcaaagcagattgatgagctctctgcattctattcatggtgtaaagatactggagttgcaaggtcatctgagtacccagaggtgcagcgtgtcactgataagttgctggagacgctagaagagttcatgagggaccgggcaaagaggcctaagagcccaacacg

SEQ ID NO: 78002 - DNA, 293 bp, Zea mays
  Clone ID: LIB3079-012-Q1-K1-D3
tgccgtcttctcatctcgctcccctctttgcgccgcccccagatccggcaccgccggctggtcgaacccgcaccccacgcccgcaggccgggaccggtgggcgcgcgccgggcagtaggagggagaggaagggcggcatggcggcgccgccggcgagggcccgggccgactacgactaccttatcaagcttcttctcattggggatagcggtgttggcaagagttgcctcctgttgcggttctctgatggttccttcactacaagctttattaccacaattggtattgacttt

SEQ ID NO: 78003 - DNA, 314 bp, Zea mays
  Clone ID: LIB3079-012-Q1-K1-D4
caagaactccggcaacggcgccggcgtcgacaagaggttcaagagcctgccggcgggggaggcgctgcccaggggcgaggccatcggcggctacatcttcgtctgcaacaacgacaccatggaggagaacctcaagaggcggctcttcgggctgccgtccaggtacagggattctgtgagggccatcaggcccggcctgcccctcttcctctacaactactccacccaccagctccacggcatctttgaggctgcaagcttcggaggatccaacatcgatccagcagcttgggaggacaagaagtgccccggcg

SEQ ID NO: 78004 - DNA, 305 bp, Zea mays
  Clone ID: LIB3079-012-Q1-K1-D5
gtctccactctggagtctggaactcccctcatcctccacatctccaccgcaggggagctaggaaggcgaagccgaaggcgcggcgcggcgcggcacggatcgagcgatggcggtggcccctcctacagcggcggcgctggagcagctaagcagcagcaagatgttcgacggctacaatctccgcttccgccaccagagcgccacccttggctgcgccatgactttctccatctacctgcccccgtccccggcgtccaaccttcccgtgctgtactggctcttcggtctcacctgcaccgacgaga

SEQ ID NO: 78005 - DNA, 355 bp, Zea mays
  Clone ID: LIB3079-012-Q1-K1-D6
tcgcccacgcgtccgcccacgcgtccgctcttccaaaaccatatttgtgtatgttggtggagtttccctaccctgtagcatctggtgcgctgatccgttgttgttgccagcgcgtctgtccgagtaggatggtggatgtgtcgtaccgtcggctatccaacagtctatagtagtagtatgattatagcgacactcggtgaagcccgccatgtaatctgctagggttcatgcttccctaaggtactggcgctttagactggctaaagaccgtacaggaattgtatactaaaaggacatggacagtcccagatgatgaatgatgtattgatgtgcctgttgactatgtgaggactga

SEQ ID NO: 78006 - DNA, 443 bp, Zea mays
  Clone ID: LIB3079-012-Q1-K1-A3
agcttgaagggtcttatccttagcaaggctttgatggctcagaaagatgccgaagatgaaagcactcggatagccttcgaaaacctacgctcggaagttatatcacttcggaatgaggcccttgagaaggacaaaatcttgctttctttagttgagaggttaaagtctagcgacgctagattggctagtctttctgaagtggaacaaaaaatggagaaatttgaaaagaagaaagaagcagatgcgaagcgtattgctgatttagaatatgctctatctattcaagcgagattgcaaagattcgaagtagaaggactggagaagaagcttgatgaaatcactgaaaacttcaatgtcgaacagacagaacgtgagatatctgaatccaaacgattgagagtttcaaggaatggttaaaagctttgtcaggcgaaggaggatgc

SEQ ID NO: 78007 - DNA, 430 bp, Zea mays
  Clone ID: LIB3079-012-Q1-K1-A4
gtgaagtggcgttcctgaaggccgtcacaggcgaaacccataaggagctgcattccggtcgtagagttttagcaggggaacagtcgcgcgcgttccagctccaggttgaagtgttccatctcaagcagaggctgcagatactggagggaagatcaggaacacccaacaaacaaccgctataggctatagtggtcacatttctacatttctgcacatcgatcgttgcaagtttgcaaccccccaccccccaatgtaaatgattgtgtggcgagctttatggtaccatgttagtacatgcgctgatgttgatctgtaattttgcaggtatggtaaaactattaatagctgacggattgaaccatgctaatatgtggagatattgaactgtaatttgcagggacatggtaaaaaaataaaatgtgccagctct

SEQ ID NO: 78008 - DNA, 365 bp, Zea mays
  Clone ID: LIB3079-012-Q1-K1-A5
ggtgatccagagagagatgccaaggcaatccgaattttccttgaagatggacacgaaattggatgtgctcagtcatacgcaaagaacatgggactttatggacaaagagcaggatgcctgagtattttgtgtgaggatgagatgcaagcagttgctgtcaagagccaactgcaacagatcgcaagaccaatgtacagcaacccacctgttcatggtgcactggttgtttctataatcctcagtgatccagaattgaagagtttgtggttaaaagaagtcaagggtatggctgatcgtatcattggaatgcggaaagcacttaatgaaaatcttgaaaagctaggttcacctttggcatgggatca

SEQ ID NO: 78009 - DNA, 256 bp, Zea mays
  Clone ID: LIB3079-012-Q1-K1-A6
aaaaaaaaaacaaaaagccaacacaatcaaaaccaaaaaaaaaactacattccggtgggaatagttatagcaagggaacagacacgcgcgtaccaactccatgatgaaatgtaccatcatcaagcaaaaagctgcaaatactgcagggaagatcaggaacacccaacaaacaaccgctataggctatagtggtcacatttctacatttctgcacatcgatcgttacaggtttgcaaccccacaccccccaatgtaa

SEQ ID NO: 78010 - DNA, 302 bp, Zea mays
  Clone ID: LIB3079-012-Q1-K1-A8
gcgcccacgcgtccgaaaaaaaaaaaaaaaaaaaaaaaaaaaaaaaaaaaaaaaagggaggaaaaaaaaaaaaaaaagaaaaaaaaaaaaaaaaaaaaaaaaaaaaaaaaaaaaaaaacatgtcaagcagaagcatgggacactggatggaatatcaggaacaccaaacaaacaaccgctataggctatactggacacaaatttacagggctgcacataagacggtgaaagttggaaaaaccccagggtacaatgtataagattgtatggcgagcattatggtactcatgtgatgacataaa

SEQ ID NO: 78011 - DNA, 240 bp, Zea mays
  Clone ID: LIB3079-012-Q1-K1-A9
aaaaaaaatacaataacaaaaatttaaaatttaaacaaaaaaaaaaaaaaaaagtgaaaacttaaactaataacaaacaaccaacataaaaaaaaaaaacctacactctaaaataatactaccaacaatacacatcctcatccttaactgaccttttctactcctccttcttttttactttccctacattatagtattcatatctatccacctctctccatacatctacatcttatatct

SEQ ID NO: 78012 - DNA, 393 bp, Zea mays
  Clone ID: LIB3079-012-Q1-K1-B1
gccttgagaagaaaacatccaaggtcaccctgtttgcattgccgctctgcttcctgtggcttgtcattgcatttcacttgggccggctgcagactaatcttgccaggcttcaggctgcttctgctccgtcctactcctgaacaggaagctgctgcgagtgtctttggagatgtgcttccagaatgtttgaacaggcatggcgagaagtggttgtcatcaatagttagttacttagtttacacgtcttgcaggaatttcaggttttattgatggagaaaccttcagaatacagtagcaaccattactacactacagaagagtttagcatacacaaggggggagaaatagtacaccatagacatagactagcacactatttacaaattcaatatc

SEQ ID NO: 78013 - DNA, 407 bp, Zea mays
  Clone ID: LIB3079-012-Q1-K1-B10
gaaatccataaatcttgcacaagaagagtcactggcccttagacgaaatgccaggagctctggtattgaacatttagctgctcagaagaaacgcaacagcactgaaaatgagggtgaatataaggtccatcgttctgaatcaactaagagtttgtctgcaaaagcttatagtagcagctatgctgttgtcgcttcagaagatgaggatgtctgccctacttgcctggaagaatacacgccagacaatccaaaaataataaccaagtgctgtcaccattttcatcttggttgtatttatgaatggatggagagaagtgatacatgcccaatttgtggtaaggaaatggagttttgcgagagcccatgatagcctttcggtttacatgatctcacatgaagtctgagct

SEQ ID NO: 78014 - DNA, 433 bp, Zea mays
  Clone ID: LIB3079-012-Q1-K1-B11
caattcgttctggatttgcaatgacagaaccacaagttgcatcttcagacgcgacaaatgtagaatgctcaatatccaggcaaggagatttttatgtgataaatggaaggaagtggtggaccagtggagctatggatcctaggtgcaaaatcctgatattaatgggaaagacagatttttctgcacctaagcataagcagcagtccatgattttagtggacatcaacactcctggggtgcagataaagagaccattgttagtctttggttttgatgatgcacctcatggacacgcagagattacatttgaaaacgtgcgtgttccagtaacaaatatcctgcttggagaagggcgtggttttgagattgctcaaggaagacttggtcctggaaagttacatcattgcatgaggctagtaggagcagcagaacg

SEQ ID NO: 78015 - DNA, 429 bp, Zea mays
  Clone ID: LIB3079-012-Q1-K1-B12
ctattctctctgcatttcaaccttctgatcctcctcttgactttcctctcgcggcagatatataatgatctatattcagaccaggacatctacatgacactaacggaacgaagcactggactcctgatgctatgcatcctatgcccataattgtcatttatactgcactaaccgattgtcgcccacctacacataagtcagcagtgcacaaacgttgctcaatctatactcgcctgcagcatatacatactccattgctacgttgtctacctgttgatgcacctcatgacccaccctcaattacattagccaacggacgtgtaccactaatacaaatcctaataggacaagcacgtcgttatcagattgctcaacggacacttctggctcgaatgctacatcattctaataggcatgctgtaccagtac

SEQ ID NO: 78016 - DNA, 374 bp, Zea mays
  Clone ID: LIB3079-012-Q1-K1-B2
ctatactatactctaggaagcaaggacaccaccgccatggcagccaagatgcttgcggtgttcgctctcctagctctttgtgcaagcgccactagtgcgacgcatattccagggcacttgccaccagtcatgccattgggtaccatgaacccatgcatgcagtactgcatgatgcaacaagggcttgccagcttgatggcgtgtccgtccctgatgctgcagcaactgttggccttaccgcttcagacgatgccagtgatgatgccacagatgatgacgcctaacatgatgtcaccattgatgatgccgagcatgatgtcaccaatggtcttgccgagcatgatgtcccaaatgatgatgccacaatgtcactg

SEQ ID NO: 78017 - DNA, 346 bp, Zea mays
  Clone ID: LIB3079-012-Q1-K1-B3
cgcttgttcctgcggcgcctcccgcccacctcctgctggtcctggccctcctcgtgatcctccgccgcggcggcagcaggaggaggaggaggagggataggggtagccggctgtggcggcgcgttgacggagcgcggagacgaggtggaggaggccgacgcggcggacccccgcgggagggccgcggcgtaggaggaggagcagctgctctcgctgaggtggatgagctgctccgccgccgcgagctcccgcgccgtgaaccgcgccgggttcggggcctgcgcctcgtcggccatggccccgcgcggtggactgaggacggatcgatcgacgcaaacgccggcgg

SEQ ID NO: 78018 - DNA, 356 bp, Zea mays
  unsure at all n locations
  Clone ID: LIB3079-012-Q1-K1-B5
gcggtctcttccgtctcggaggtgggagagagcgatcagcggcgtcgccgggtggagccaaagcgcgcgagaaaatgcagggcggatccagcggcatcgtgtatggtggcctcaagtaccaggcgcggtgtatcgccgacatacgcgcggacgccggctcgaccaccttcctcgccggcaccctcagcctcaaagaggaaaacgaggtgcacctgatccggttntcgccggcggagagcgagctggtgtgcgatggcctcttctaccaccccaacgagatttgggacctcaaatcatgccccttcgatcacagggttttctgcacagtctacacgtctggtgagggctatggtgca

SEQ ID NO: 78019 - DNA, 414 bp, Zea mays
  Clone ID: LIB3079-012-Q1-K1-B6
ttgaggttttgcaaaggcttgtgaactgtcttgatcactgtgcctcaagaacaggatcactgcctgttcaaactgttggccttttaccgttacactgcagcagattttcgctgagctgtttgcagatgatgttttctttatgcagttgcataaggaacgcaaccttgtgtgctgcagcatcagaaaccaacaaagtttcaatttccattctaatgaagcgatgtgaggttatattgggtcaatttttggccgatgaaaatgatctaagagaacatcctttgcctagtgtgagggttgaaataacgatctgtgttcttcaagagcttgctagactaattatagacattgatgcagcgaatactttcaacatacctgcatatctgaagcaagctttgggggaaaacaaatcccatg

SEQ ID NO: 78020 - DNA, 307 bp, Zea mays
  Clone ID: LIB3079-012-Q1-K1-B7
aggaataaaagaagcctgcaacccacctaaatacagaaacagaacctactaaacgtaggacaacacaacaaaaacaagaggaaagaagaagaagaataggcgtagacggcaagagacagcacacaaacaaagcgccggccactctgtggaccccgcctacgcgtccgcccccaccccacagggcctccttttctagagggggaccaaattctctcgctcaggccgatgagctacaccgtcgtcacgggctatcccgccgcgtaccccaccttattccccgcctgcgcctcccccgatatggcccctg

SEQ ID NO: 78021 - DNA, 309 bp, Zea mays
  Clone ID: LIB3079-012-Q1-K1-B8
cccacgcgtccgctaagttgttggatacatacaagactgtgctctcaagagagactggtgggtactctgctgaagaaaagaccaattggcctgaagactaaattgtccatcttcaattgcaccaagagaaaggatctccattgcactggtggctggtgcatgtttgaggcttggatgatggcagaagtgtcatgtttttttatgttgaaccttgtttctaaatagtaagtctagacaattgttctgtttgaaatctgaatgaattgtggctggttgttggtggactggattacaggcaaaataaaaaca

SEQ ID NO: 78022 - DNA, 435 bp, Zea mays
  Clone ID: LIB3079-012-Q1-K1-B9
aaaagttctagctgaaaacaacatatttgctctacatgctgacaatatgacggggcagagcatttgatggatggtgcaactgttgagtttgactattcccctcattggaaaaatgaaagtgatcaaccgaattggtcttcagtatcatgtttgaagactgctgctgatgctgcatgttcaatgtatactttgtctctaaatcgagaagctacaccaaatcttattgtgtcatctgagagatcagtcaagtcaatgactgaacagcagttagatgaaaacagtgaaaagcatgaagaaaatagtggaaggcttgaagaacatggtggaaatcctgttcaaacttcctatgatcaaattgttaatggctgcagtggaagagggaatagaaaattctgcagtggaagaaggaaaggaaaaggaaaatgataaggaaaa

SEQ ID NO: 78023 - DNA, 366 bp, Zea mays
  Clone ID: LIB3079-012-Q1-K1-C1
gacttcgctaaaggaagaagtacacaaactcctcgcagcggcaatgatggatctttgcagaaggctgctcggggtaacagcagctcaatatttatccggggctttgataaaaatctttcagaggatgagatccggagctctctcgaacaacattttagtgattgtggtgagatgacaagggtctctatcccgactgatcatgaatctggtgcaataaaaggaatggcttacatagacttcaaggatcaggactctgtgtctaaagcccttgagctcagtggctctgacattggtggtggctatgagctttatgttgatgaagccaaaccaagaggcgatggccaacgtggtggtggtagatctggt

SEQ ID NO: 78024 - DNA, 87 bp, Zea mays
  Clone ID: LIB3079-012-Q1-K1-A2
cattgtacttgtacctcagaagtcagcaagactgcgacaataattgcatcgcgtctgtagacagcggaatgcatgagtagctactgt

SEQ ID NO: 78025 - DNA, 368 bp, Zea mays
  Clone ID: LIB3079-011-Q1-K1-G5
gcctgatcaagtggtggttcagcgcattgatgagaggttatctgcccttggcgattgcagagcctgcaatgaccatgttgcacttacgcaccctgaccttgacaaggagactgaggagttcattgcagatgtgcttggggtcgaggtgtttaggcagactattgctggaaatatccttgtggggagttactgcgccttctctaacaggggtggtttggttcatccccatacatccgttgaagaccttgacgagctctccacgctcctccaagttcctcttgtcgcaggaactgtgaacagaggaagcgaggtcattgctgcaggcatgacagtgaacgactggactgcctttgtggcttcgacacgac

SEQ ID NO: 78026 - DNA, 426 bp, Zea mays
  Clone ID: LIB3079-011-Q1-K1-G6
gccactaccaccaccgcaagcgacgacggggagatgtttctgcgacggatcctgaccgggggaggtggcctggcggcgctgagggcggcgcgcgccgtgaaggagacgaccgggatcgtcggccttgaggtggcgcccaacgcgcgggaggttctcatcgggctctacacgcgtacgctcaaggagatcgatgccgtccccaaagacgagggctaccgcaaggccgttgagtccttcaccaatcaccgcctacagatctgacaggaggaggacgactggaagcgcatcgaggaccgaatcggatgcgggcaagtcgaggagctcatcgaagaggccgaggacgagctgaagctcatcgccaaaatgattgaatgggatccgtggggtgtccctgatgactacgaatgtgaagtgattgaagacgac

SEQ ID NO: 78027 - DNA, 166 bp, Zea mays
  Clone ID: LIB3079-011-Q1-K1-G7
cacttcttagttaccatctgcagcgacctttctcgggggtgctagccggatccgcgatcggggaaatcccaagctgctccacaggcccgagggtcggtcgtcctcatggcggggatcctggcgtgggcggctgacgtggtcggccgggccggtgtcatcgacctct

SEQ ID NO: 78028 - DNA, 448 bp, Zea mays
  unsure at all n locations
  Clone ID: LIB3079-011-Q1-K1-G8
cccacgcgtccggcgctcgtcacctccaatcaacaaattcccaatccgccggttcccatgccgcgttcgccgctccatttgatcgaattcccgatggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgacatcttcgagaagctggctgccgaggccgncaaagctcgccgctacaacaagaagcccaccattaacctccgggagatccagacttcggtgcgcctcgtccttcctggcgagc

SEQ ID NO: 78029 - DNA, 457 bp, Zea mays
  Clone ID: LIB3079-011-Q1-K1-H1
aaagatattccattttatgattggtctatcaaacatagtattcctagtatatttcgtgtggaccatgattgctacttgtcagagatggatttgctgggtacatggatgtggatttgttctcatggctagtccatatatattgcttcttgcttctttcctcttgctactgtcattctgggttgacctgtgtcatcagacaaatgatgaagacgaagaagatggaaggagtcagagtcaccatgaagctttactagacagaacaaaagcgaaacctggcattcatcctgttaatatccgtcagaggtgttgcccaggaatacagcttggaagccggcaaaaatttgtgattttggtgcttctactgtcatttgttgttatgcttgcctttgccatcctcatatgggttggtagaagagacaatcctatcgattcttctctactgaaaagggtttatttg

SEQ ID NO: 78030 - DNA, 430 bp, Zea mays
  unsure at all n locations
  Clone ID: LIB3079-011-Q1-K1-H10
cctcaacacgctgggcatctcgctggcgctcatcgactacgcgcccctgggcgtgaaccggccccacatccacccgcaataacaacgacaaaaacgacatggactttaagttaattttcaaagatttcgtaaaaaagttaattttcaaaggtataatgatagtgttataattactttctaccttcgtggattgtatgctgcatgttatattttgtctcaggattgtgcgtattacgttttgacttgatgctgtagatgctacaacagcaacctccacgtctaaaaatatatacattgttatgcgctatcctttgaaactttataatcacattatctttacaactaattaagtactcattgtaggcgtncacacgccgcgagctcggggcgggacagcctncacggtggcggggtcacgctgaacagggag

SEQ ID NO: 78031 - DNA, 195 bp, Zea mays
  Clone ID: LIB3079-011-Q1-K1-H11
cccacgcgtccggttgcccatctgtgtttttgattgcaaggtcgctctgtgtcagttgggagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 78032 - DNA, 379 bp, Zea mays
  Clone ID: LIB3079-011-Q1-K1-H12
cccacgcgtccggagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccagctcgccagcgccaagtgagcaccttttttttgcctttttcgtttccgaggagggcgtcgtcgatgccaatttgtttccaataaacagggctgtgccc

SEQ ID NO: 78033 - DNA, 450 bp, Zea mays
  Clone ID: LIB3079-011-Q1-K1-H2
ctatcaggtggcctaccaaacttctataagttaccacagaagatttgcctatcattgtagtagttatgtcagatattaatgttagagaatctggttcaagtgcagatcgtccttgcttgaacgcatgcctgtattagatgaagctaggtatctggtgaagcgggctactgctacacaatcaactatttcagcagataaaattgctccaacagtcactcctggaagccttaagcttccgaatggtgtagcaaaacccacctcagctcctttagctgatttgcttgatttcagttctgatggtgccccagcttccaccgttgcttctactacaacacctaatgattttttgcaagatcttctgggtattggtggagttagttcatcaacgacaggtgtaacttcaaccgcaagcacagatattcttatggatcttctgtccatgggatcatc

SEQ ID NO: 78034 - DNA, 449 bp, Zea mays
  Clone ID: LIB3079-011-Q1-K1-H3
cgcagtttcacagacagcatccattccacagtcaccagagcactagagcagagcaacaacgcgacaagagcagagtgagatcgtcgtcagcgagcccagcagatacgagagagaggatggcggacatcgcgttgctggtggcggagcagttcgagaagacggcaaggcgaggcgcccccggcggggacagcggcagcagcagcgggagcggcggcgagacaaggaacttcggggccgtggccaaggtgtggagctcgtgggtggagtccgccttcgccgccgcgtccggggtcagattcaccgtcgcggtgcagctggagcccaagaccgggctcgcgctggccgctgccgacggcctcttctccgcctagcttcctgcctgcttccatgtctttctcctgagcagtgccagtgatcgagcgagtcctgctcctgcaccccgtactatg

SEQ ID NO: 78035 - DNA, 213 bp, Zea mays
  Clone ID: LIB3079-011-Q1-K1-H5
gtgcttgcttgcttgttgctagttgctttgctacccaataatctgaatggaaggacgtatgtgatgtgcctgctgaatagttcctagtccttgcatacactgctgtgctaccacatgacatgatgtactcgtgtgtgtgctttggttgttgtgtaattccatgaccatgatcagtaatctgaataaaaaatattggagatgtgcttgcttcct

SEQ ID NO: 78036 - DNA, 415 bp, Zea mays
  unsure at all n locations
  Clone ID: LIB3079-011-Q1-K1-H7
cgttccagtaggtacatcaggcgcataccaaaaccagtctcagccttctttcctgatccgtgatgcctctcagcctataacattgatgacagtgactagtgatactagtgatcatgctggcgaatgctagacgtcattaccatacagcaggccagcagccagtaaggagctccactttggcagcctgccactctgcttcttccactcctgaaaccgagcctgcaggtgcaggcaatgcggttgcttgctggagtccttatccaatcagtgaaggcactaaactcgcaaagccgttggaatctgcgagcaaggtcatgcacatcttgttggatgaagttaatacagcctgcacttgaactnccgcactctcgcgatcgtgtggaagacgtgggcgccgttgagggtcaaaatcttc

SEQ ID NO: 78037 - DNA, 253 bp, Zea mays
  Clone ID: LIB3079-011-Q1-K1-H9
cggacgcgtgggtagaaaatgtatggatataatgtaggagtatcagcctatcaggagtaggtatgagatgtaaagctcagcccgtagtttagatgtaaagttttgtactgagtataaaaaaaaaaaaaaaaaaaaaaaaaaaaaaaaaaaaaaaaaaaaaaaaaaaaaaaaaaaaaaaataaaaaaaaaaaaaaaaaaaaaaaaaaaataaaaaaaaataaaaaattataaaaagaaaactaaaataaattaa

SEQ ID NO: 78038 - DNA, 302 bp, Zea mays
  unsure at all n locations
  Clone ID: LIB3079-012-Q1-K1-A1
cgcaccttctgttggctcctcctccgtcctcccccaagcgccccctctcggccggtcgaatttccggggagggggattggggggatttgatatatatcgagagagtagtgtttgtcccccgattcctcatgcgtggcgcccaaaacctagagatccttttttgcgcccgaaaccttcctgagctggtccgattcggtgccgttagaggggatctgtgtacctcgccgtcggccggcgctgtcgatctggttgtcttccacggatggtttccagacggtgactccgncggcgcggcgcggcgc

SEQ ID NO: 78039 - DNA, 329 bp, Zea mays
  Clone ID: LIB3079-012-Q1-K1-A10
cccacgcgtccgatttcattcggtgccaacaagtgccaagtgctcgtgtccggatgcgccagcgccgcctggtcaacagatttttgccctgcgctgtcactccaccacgctgcttgtactgaaagctttttcccagaataaaggctggggaggaggaagcggcggcggcggcgctctcagaagagagggtgagatgaagactcggagctcagcgagaggggagccgaggcgtctcggaaatgcggctcttctggcgctcatgctctgctccgtcgtcgcgctctacctcatacgggggagattcgccccaattggagatgccatcaaat

SEQ ID NO: 78040 - DNA, 281 bp, Zea mays
  Clone ID: LIB3079-012-Q1-K1-A11
gacttatgtccagttcacatggtacccaacttacatgaactcaacatttcggtgggctgaacaaacacaagctcatgacattattgatccgtgctatgacttgacgcagatgatagaactgcatgctctgctaacgatctagcgacggagactagctattctatgatggagatagtctgagaattacagcttatcaccagactatgagcttagtccttgagcacacgatcgtgctgtgaaatgcgcgtaatatagcgctcatactctgctgcgatacgaaa

SEQ ID NO: 78041 - DNA, 304 bp, Zea mays
  Clone ID: LIB3079-011-Q1-K1-G4
cggacgcgtgggcggacgcgtgggcttgtcacttgagaggtggtgttgtatggactggtgtagctggctcccccgtgcttccatcgacccgcttcgcgcttcatgtttactacttgcgatactgttgttacttgtgattgatgatgataaaagccacggcctgtgttactactgctgtaacaagtccgacagaagaaccatccaatgcaggcccacgaaggggatccaggctgcgccggcctagtactcggcttagggagtttgtgtgagttgtaattgagatataagggaatattgattaggg

SEQ ID NO: 78042 - DNA, 356 bp, Zea mays
  unsure at all n locations
  Clone ID: LIB3079-012-Q1-K1-A12
ctacactgaaccctgctgctgatttgcagcaacaactatcaccatttagccagcgtggctactgactactctcagcagcaacaactgcttccatctaaccaattggccgcactgaaccccgctgctcatttgcagcagcatatactactaccatggaaccagctggctgcagcagaccgagcttccttgttgacacagcaactgttagtgcctttctaccagcaatttgcggctaaccccagaaccctcttacaactacaacaattggtgccctttgtccaacttgctttgacagacccagcggcctnctaccaacaacacatcattggtggtgccctattttagattgcttatta

SEQ ID NO: 78043 - DNA, 434 bp, Zea mays
  Clone ID: LIB3079-011-Q1-K1-E9
gggtcgttggcgcagtatgggatgaagcacatgcggtccttcgcaaacatctgcaacgggggcatgcttcctgaagcagtgtcgaaggtcgctgctcaggcttgcaccagcattccttccaacccctggagttctatccacaagggttttagcgcctaagaatcataaggtgaggcgaaatatttcagccgctccaccgcaacgaactggtttacattaccagtcctcaggggggtcctagttcttgaaccataggtgaagcagacttataccactattatagctgttccaccgtcgttccagattacatagctatgcccaatttccggtgtacatatatagtcggaaagttatttggcaattgtattggtcgttgctgtatatattccctatagttcgttagcagatgtgtagtttgtaattccataaaaatg

SEQ ID NO: 78044 - DNA, 442 bp, Zea mays
  unsure at all n locations
  Clone ID: LIB3079-011-Q1-K1-F1
cccacgcgtccgcccacgcgtccggcgagagcttcgctgtgatcaactccatgcccaaggcgctggcggcttacctcttcagcaacgacgggcagctcaagcagcagttcgagaggaccgtctcggcgggagggatcatgttcaacgacaccggcatccacctgacaaacccgaacctgccgttcggaggagtcggggagagcggcatgggcgcctaccacggcgccttcagcttcgacgccttctcccacaggaaggccgtcctggaccgcagcttcctcggcgaggccagggccaggtacccgccgtacacgccggcgaagctcgccatcctcaggggcgtgctcaatggcagcccgcttgccacggttcaagcggctgcngggtgtacaagaggggcatcagctgactgactgactgaccccccttcatgctntatatt

SEQ ID NO: 78045 - DNA, 396 bp, Zea mays
  Clone ID: LIB3079-011-Q1-K1-F10
cttctaccaatctgttaactacgcatccaacaatccatttgttccagcaatgaactctagggtttcttttgaggatcctatcatgaatctgcactctgaccagggaagtaactcccttggctgctcagacttgggctgggagaatgatactaagacaccagacatcacatccattgctcccattcccactattgctgaaggcgatgagtctgtatttgtcaactccaattcaaacagctcgatggtgcctcctgtcctggagaacaatgctgttgatctcactgatgggctgacagatttggaatcctatatgaggtttcttatggatggcggtgcaagtgattcaattgatagccttctgaaccttgatggatcacaagatctttgtagcaatat

SEQ ID NO: 78046 - DNA, 305 bp, Zea mays
  Clone ID: LIB3079-011-Q1-K1-F11
aaaagaaaaaaaaaaaaaaaaaaaaaaaaaataaaaaaaaaaaaaaaaaaaaaaaaaaaaaagaaaaaagaaaaaaaaaaaaaaaaaaaaaaaaaaaattttttcaaaaaaaaaaaaaaaaaaaaaaaaaaaaaaaaaaaacaaaaaaaaaaaaaaataaaacaacggacaccacataaaaaacacaaaattcccactattagctaaacgcaatgaaactgtattcatcaacaccaaaaaaaacagctaaatagcgccttttaaaaaaaagaacaatgcaaaaaacctcactgaccaccaaacaa

SEQ ID NO: 78047 - DNA, 437 bp, Zea mays
  Clone ID: LIB3079-011-Q1-K1-F12
gtccttcttcgcctaggtcactcgttgatggtgaaggttacaatagtgctgatgaacagggtccctgttacgcctcgagttatgatgattcggaaagagagcgtatgtttgagcatgacctaaggcgagtgaaagggttggaaatcagaaagacggccgaagatgggaactgtctattcagagctgttgctgatcaagtttatggagatgcagaagcttatgacatggctaggcagatgtgtgttgattatatggaaagggaacgggatcatttctctcagtttataactgaaagttttacattatactgcaagaggaaaaggagagacaaggtttatggcaacaatgttgagatccaagcatttgcagagatgtacaatcgtcccattcacatatattcctacagtacagagcccattaacatttttcaaggaagc

SEQ ID NO: 78048 - DNA, 453 bp, Zea mays
  unsure at all n locations
  Clone ID: LIB3079-011-Q1-K1-F2
cccacgcgtccgcccacgcgtccgcatgaccatcaacgcgctggcgcggcagacgctcaggaacgggggcggcatcttcgagatgaccgtcttgccgggcaagtacgcgctgggcatgtacttcgtggtgtacaagagctggaacttcaccgagcagggcctccccgccgacctcgtcaagaggggcgtggcggtggcggacccgttcagcccgtacaaggtgcggctgctgatcgaggactacccgtacgcgagcgacgggctggccatctggcacgccatcgagcagtgggtgggcgagtacctggccatctactaccacgacgacggtgcgctgcggggcgacgaggagctgcaggcgtggtggaaggaggtgcgcgaggtccggcacggcgaccacatggacgcgccctggtggcccaagatgcangccgtgtccgaactcggcagcgc

SEQ ID NO: 78049 - DNA, 192 bp, Zea mays
  Clone ID: LIB3079-011-Q1-K1-F3
cccacgcgtccgaaaaaaaaaaaaaaaaaataaaaaaaaaaatagttgtgccttctctgagcaaaaagaaaaaaaaaaaaaaaaaaaaaaaaaaaaaataattgtgccttttttgaccaaaaaaaaaaaaaaaacaaaaaaataaaaaaaaatctagccttttatttgaccaaacaaatatctatcattagc

SEQ ID NO: 78050 - DNA, 255 bp, Zea mays
  Clone ID: LIB3079-011-Q1-K1-F4
gtggaatgttgtttgcttataccgcagttttcgactaaaaaaaaaaaaaaaaaaaaaaagaaaaaagtaaaaataaaaaaaaaaaaaaaaaaaaaaaaaaaaaaaaaaaataaaaaaaaaaaaaaaaaaaaaaaaaaaaaaataaaaaataaaaaataaataaaaaaaaaaaaaaaaaaaaaaaacaaaaaaaaaaaaataaacaaaataaaattaaaaaaaaaaccctacaattacaaaaatcaataccaatag

SEQ ID NO: 78051 - DNA, 272 bp, Zea mays
  unsure at all n locations
  Clone ID: LIB3079-011-Q1-K1-F5
cccacgcgtccgcccacgcgtccgaaccttcctcctggtggcccaggttatgttgggaagccacactacatgcctccacggccacaagagaactattatcctcctcccgatgtgccccctgtagaaaagcagccacactatggaatttcttcatatggacgagatgcacctncaagtgctcccccagggaatcaaaaccaagcacatgggtcatctcaggtgacacacagcatgcaagttcctctttcctatgctgatgctgtgataagggc

SEQ ID NO: 78052 - DNA, 272 bp, Zea mays
  unsure at all n locations
  Clone ID: LIB3079-011-Q1-K1-F6
ctaagtccaggtactgccgtggtgtccctgaccccaagatcaggatctacgatgtcggggtgaagaggaagggtgttgatgagttcccctactgtgtgcaccttgtctcttgggagaaggagaatgtctccagtgaggcgctcgaggctgcccgcattgcctgcaacaagtacatgaccaagtctgcaggaaaggatgccttccaccttagggtccgggttcacccgttccatgtcctncgtatcaacaagatgctttcctgtgccggggct

SEQ ID NO: 78053 - DNA, 260 bp, Zea mays
  Clone ID: LIB3079-011-Q1-K1-F7
gacccactcgtcctctcagtccaactaccacccatcttaacctttttccaacatcaccatctactaggactaagtcaaatttcacaccttcaatgacactcaataactattatacttcttccattatgaccaactataaaaaacacccacactatctaaacacttacctaaatcaacattctactacaattacctactctacaaataacaacccatcacatccttcatctcagtttactcacaaccatctacttcctatt

SEQ ID NO: 78054 - DNA, 386 bp, Zea mays
  unsure at all n locations
  Clone ID: LIB3079-011-Q1-K1-F9
aggaatcctggagatacaccattcaagtttctatttgacaaaaactgtccagactacagagattatgagtttcagcttgctgaagaggaaagggctcttgctcagtcaaaggaggctgaagcatcgaaaggtgctaactctggcactgcaagcttcaaggcaccaggtggtacttatagaagctcatttgaacagaagtctaactatcagacacctgcatcagctttgtacggggcatatgagggtagttcttcccaaggaagctcttctagttatggtgatcatacagctncaccatcagatcctgtagcattgatggaattctatgcaaagaaggctgcactggaagaacggaagaggccaccaaggcagtcgaaagatgaaat

SEQ ID NO: 78055 - DNA, 447 bp, Zea mays
  Clone ID: LIB3079-011-Q1-K1-G1
aaaataatgagagcaacacttattctacctgttctgaagcaggaccaaatttggaaagacgcagtcggaattcgaagacatctttgatgttgatcattttataaattatttgaaggatgatgtacggattgtccgagatatccctgactggttcacagagaaggatgagctgtttactagtataaagcgtactgtgaagaacatcccaaagtatgcttcagcacagttttatattgataatgtacttccaaggatcaaagagaaaaggataatgtctatcaagccatttgtggacagattggggtatgataatgtaccaacagagattaaccggctgagatgcagagttaactatcatgcattaaagttcctacctgatattgaagaaatggctgttaagcttgctgcaagaatgaagaacaaaactggcagcataaatccatacat

SEQ ID NO: 78056 - DNA, 403 bp, Zea mays
  Clone ID: LIB3079-011-Q1-K1-G10
cccacgcgtccgcttatgttccgcattctcaagggccttctcttccttggttttgtctcggtgatggcagtcctatttgtcgtcttacaccttactatttctgatgtcttcgctagtatccttggatacttgcctactggatggtgtcttcttctgattggacaagcatgctcaccattgattaggaggaccctgctgtgggactccatcatggagctcggaaggtcatacgagaatataatgggtctcgtcctcttcctgccaattggtttcctgtcgtggttccccttcgtctctgaattccagacacggctgctgtttaaccaggcatttagccggggcctccagatctcaaggatccttgctggtcaaaaggatgttagcgagttcgagttcaagtgac

SEQ ID NO: 78057 - DNA, 349 bp, Zea mays
  Clone ID: LIB3079-011-Q1-K1-G11
cacgcgtcctcccagaatcataaactcgctcattccgcctttaccctcgccctcgttcgaaagggccggggacggctttctagcgatttgggtcaacatgaatccccagtactactaccttttcaaacttctgcttattggcgattctggtgttgggaaatcatgcttgcttctcagatttgtccaccattcttatttggacagatatatcatcacacttggggttgatttcaaaattcgcacatttgaacaagatgggaagaccataaaacttctcatttgggatactgctgggcaagagctctttaagacaattacttgcatctactatcgcggagctcatggaatc

SEQ ID NO: 78058 - DNA, 371 bp, Zea mays
  Clone ID: LIB3079-011-Q1-K1-G12
cccacgcgtccgaccacgcgtccgcattatcagatgacaaacaattggtccccgggctggtttctcgaatagaacagggaactgatgttctacgtgggaagacccttttgtttgttgctctgctttgcaagaatagtcgaaggtggcttcctcatttcttttgcaatgcaaaattaatctcagctgttgatagactgggaaaagagaaggagggttttattcatcaatgtacagaagcatttgtgcagttggttgcttccttggtccctggtattcttgacactgtctccagtgatatacaacaggttatggttggcaaacgccatggacctgttactgctttagctgggcgagctcatccaaagagcaca

SEQ ID NO: 78059 - DNA, 250 bp, Zea mays
  Clone ID: LIB3079-011-Q1-K1-G2
agaactttgtacatgcgttggtggatggtggtgtaacatagtggctgccaacaagtcatgctcatgcaaaccgatgaatctatctctgtatcatcgatctcggttgcttgctagtccagactccagacatggctatatatatatagctggtgctaataaataggagtataatcgtcatatcgatcggttgcgtgtggaatgccaatcatgtgtgtaatctgttggcaaataacaaacctctgttcctccc

SEQ ID NO: 78060 - DNA, 456 bp, Zea mays
  Clone ID: LIB3079-011-Q1-K1-G3
ctgagcaggtgacatcatgcaagctgtggcgtcaagtatgagagtcattcaaacctccagagacatgcacaactgtttcatggactttccgtaacttctatgagaaggcactccttgaatacgagaaacacaaaatcgaaacaggagagttccaagtagcttcatctgctctaccagaccggtttggttctgagagtcaggtgggtggaagccatgtatctggttctggaagagccagaagagaatctgcaactcgtgcaatgcaaggttggcattctcagcgcctactagggaatggtgaaatcgctgaccctataattaaggataaagggcatattgtcttaaagaaggataaaactcctaaaagcagtggttctgccaagaggaaaaggacactatccctggaagatgacagggtgataccttataaatctgatcagctacaaaatgactcga

SEQ ID NO: 78061 - DNA, 290 bp, Zea mays
  Clone ID: LIB3079-011-Q1-K1-E8
ctggaacgaaccaccagaccaacaatcgctagactccctcgagcagctagaggcgtatggagtgatatggaagcaaccagtgcaaggtgaaaagtccttcgtatccgaggcatatccggcgaaatggaacaaaccaccatcaccaagcaagcaatcgcaagactccttcgagccagaggcatatcgggtgaaatggaacaaatcaccaccaccacaccaacaatcgcaagactccttcgagtcggaggcatatcgagtgaaatggaacaaatcaccaccaccacaccaac

SEQ ID NO: 78062 - DNA, 381 bp, Zea mays
  unsure at all n locations
  Clone ID: LIB3079-001-Q1-K1-H7
aagcaaacgagcggcgggacggctagcccgcaatacaaaatccggaggaactcccaggaggcgaaaagcagatccgtctcccccgagccccgaccggcgatcgctatcgacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatgaagggatctttctggattactcgagacagcaggcgactggtgaaaccctggagaagctccttaaatgggctgacgctgcgaagctcaaggagaangatgagaagatgtttaaaggtgaaa

SEQ ID NO: 78063 - DNA, 422 bp, Zea mays
  unsure at all n locations
  Clone ID: LIB3079-002-Q1-K1-C11
cccacgcgtccgaaacagtcacgtctcccagatctaactgccccccgacgcacgagtcccaaagcctccatggcgacgcaccgncactgcctcccactcctcctcctcgtggccgccgccctcgccgccgtccctgctcgcgcggcgctgggcggcgggcgcggcccgctgctgggcgggtggaacccgatccctgacgtgagcgactcgcacatccaggagctaggcgggtgggcgctggggcaggcgaagcaccagaagctggccgncgacgggctgcggttccgccgcgtggtgcgcggcgagcagcangtcgtgtccgggatgaactaccgnctctacgtcgacgccgncgaccccgncggccgcaccgtgccctacgtcgncggcgtgtacgagcaggtctggaccccgcacccgca

SEQ ID NO: 78064 - DNA, 187 bp, Zea mays
  Clone ID: LIB3079-002-Q1-K1-C6
tatctgttgcctacaagaatgtgattgcggccccccgtgcctcatggcgcattatctcctccatcgagcagaaagaggagtcccgtaagaatgaggaacatgttgcacagatcaaggaataccgtggcaagattgaggctgaattgagcaacatttgtgatggtatcctaaagctgcttgacacgca

SEQ ID NO: 78065 - DNA, 363 bp, Zea mays
  Clone ID: LIB3079-002-Q1-K1-F10
aagcggcagtgcgtagagaggatcgtcgaacagaacagcatgaagatgggcatcggtctcgtcgtgtgcctggctctgtcagctgccagcgcctctgcaatgcagatgccctgcccctgcgcggggctgcagggcttgtacggcgctggcgccggcctgacgacgatgatgggcgccggcgggctgtacccctacgcggagtacctgaggcagccgcagtgcagcccgctggcggcggcgccctactacgccgggtgtgggcagccgagcgccatgttccagccgctccggcaacagtgctgccagcagcagatgaggatgatggacgtgcagtccgtcgcgcagcagctgcagatgatgatg

SEQ ID NO: 78066 - DNA, 454 bp, Zea mays
  Clone ID: LIB3079-002-Q1-K1-H7
aaaggctgcctgtggaatcgctggtaagcctagacaagtggtcgatgacatcgacgggctggacgtcaacaatgagctcgcggtggtggaatacattgaggacatctacacgttctacaagattgctcagcacgagagacggccatgtgactacatcgacgcccaactcgagatcaactctaagatgagggctatcctggctgattggataatcgaagtacaccacaagtttgaactgatgcccgaaactctctacctgaccatgtacatcatcgatcagtacctctcgctgcaaccagtcctgcgtaaggagctgcagcttgtcggcgtttcatctatgctgatcgcctgcaagtacgaggagatttgggccccagaggtgaacgacttcatcctcatatcagacagtgcatacagtagagaacagattctttcgatggagaagggaattctg

SEQ ID NO: 78067 - DNA, 424 bp, Zea mays
  Clone ID: LIB3079-003-Q1-K1-B5
gttacattagtattttttcccaccttatatgattgaaaactattgtttcccgtcgggtcgtgtcatagatggcttggaccctcttattatcctgggagcctcggtggtttggaagcatagaaacagagtggtgttcggtagagtttcttccaacctcactcttattctggagtctgctaatgaggaaagcgagaaatgacaagttgcatgagccaagggttatcctttctggctgctccaagccatataatttagggtggttggatccttcatggatattttaatgtacttctgttgttggccttcgtaagaagtgcatgtatcccgggcgtctttcagctctttgtattcttcgtcttttaatatagtggggcgcagttctcctgtgcttttcgagaaataaaataaaaagggcggtcgttct

SEQ ID NO: 78068 - DNA, 466 bp, Zea mays
  Clone ID: LIB3079-003-Q1-K1-E3
tatacattgggcgaggggctatcatcacatccttcattgtgtgctatgctcttacatcgggtatttctggatatgttagtggtggtctttactcaaggagcggtggcaaaaactggattaaagcgatggttcttacagcatccctctttccgttcttgtgtttttcaattggtttcgcactgaatacaattgctattttctaccgctcattagcagcaataccatttggcacaatggttgtcatgtttgtactttgggctttcatatcttttccgttggtgcttttgggaactgttgttggtagaaactggagtggtgctcctaacaacccctgccgagtaaagactattccacggcctattcctgagaagaagtggtaccttacaccttctgtcatctcattgatgggtggcctgctttcctttggcagtatcttcattgagatgtacttcgtgttcacatcatt

SEQ ID NO: 78069 - DNA, 275 bp, Zea mays
  Clone ID: LIB3079-005-Q1-K1-B10
ctcacgcgttcaatatagccttcaagatattcgctatggcaggggctatagcacattcaagatagaatgcatgtgtgcatgcgtatgcacatgagaatgcagataatatatatgacagtctctacgagtgatatatctagggatataatgacggatggcatgtccttcatcatgaacgtgatcaagaaagactttatacatgtctgcatacataagtacaaattaatgatgggatcaatcatttgtgcagacgagcatgttgtagagcatgtttt

SEQ ID NO: 78070 - DNA, 264 bp, Zea mays
  Clone ID: LIB3079-005-Q1-K1-B9
aaaaaaaaaaaaaaaatttaaaaaaaaaatttaaaattaaaaaaaaaaaaaaaaaaaaaaagaaaaggtaaaaaataaaaaaagtaaaaaacaaaaaaaaggacgcccattcttaatgttccaatcttacaaccccttccatccaaccttattactcttttatagggccccctaatttcaattcactgcccgttctttcacaacttcttacctgtaaaaaccttgtctttccccaccttaatcttttttaaccacatccccttt

SEQ ID NO: 78071 - DNA, 62 bp, Zea mays
  Clone ID: LIB3079-005-Q1-K1-D11
cccacgcgtccggttaattgtcatacatgctcccttcgtaaaaaaaaaggagtcttaagtgc

SEQ ID NO: 78072 - DNA, 320 bp, Zea mays
  Clone ID: LIB3079-005-Q1-K1-F3
agaacattgtgtagtcatgtttagcaagataccataaagagtgtatcctttcagcctacgcagagaacttggttgttcaatcatgtgcctcactgaatattgttagatgcacaggatggatgtaattctgaaaacttgaatggttatcaagaagtacttcataaaaaaaaaaaaaaaaaaaaaaaaaaaaaaaaaaaaaaaaaagacaaacgatctaaaagaatacggtcttctttctcaatgcattcagacataataactcttttatagtgtcaacctaaattcaatttactggcccattatttacaactccattgact

SEQ ID NO: 78073 - DNA, 295 bp, Zea mays
  Clone ID: LIB3079-005-Q1-K1-G10
tatatatagccaagacacacactaatactttgcattccatttcatctcagaggatagagtgatgggcggaatctccactcatgcttatcgcggtcctcctcctgctcgtttgttacaccgggactcatggcggtccggtgactatggtgtcagccaagacttgcaactcgaatagctttcgctttaatgtaccttgctacagggacgccaactgtgcagacctttgtctgaccgaaggtttcaccgacggcgtgtgcaacggcctacacgaccgctgcttctgcaccaatgactg

SEQ ID NO: 78074 - DNA, 417 bp, Zea mays
  Clone ID: LIB3079-007-Q1-K1-B12
tattgtagctcatatcatctgtcacccatggcgaagtgcagcagcttccaaggattattctggttgctttccatgattcttctagcatcctttgttgctcatgcacgcacaacaagtgggcacaccaaagaggacagcaatgctaggaacatgacgatgaccaagacgagggcatcgggcaacatacttgttagccgtaatgacgacgggccatgctatctagattccggtcttaatgagtacgtctgcagaaagactaataagtgctataagagcttggtgctctgcgtggcgagttgtcaaccatcatcatgaattcatgatactgcggagacatcatgatactgcggagacagacggcgagagatgaggctagctagatgctgtttcaccaaaatattatgtaacacccaaatc

SEQ ID NO: 78075 - DNA, 409 bp, Zea mays
  unsure at all n locations
  Clone ID: LIB3079-008-Q1-K1-B7
caaggctgcccaggacattgctttggctgagcttgctccaactcaccctattaggcttggactggcactcaacttctcagtgttctactatgagattctcaactcacccgatcgcgcctgcagtcttgcaaagcaggcttttgacgaggccatctcggaactggacaccctgagcgaggagtcctacaaggacagcactttgatcatgcagctccttcgtgataacttgaccctatggacttctgacatctcggaggaccctgcggaagagatcagggaggcgcccaagcacgactcgagcgaggggcagtaaagccggctttttaacccgtgcccctaagaagctaagtanncctagtgttttgcatgcttgtctttaatgaccacttattngcaatgtntngatctg

SEQ ID NO: 78076 - DNA, 395 bp, Zea mays
  Clone ID: LIB3079-009-Q1-K1-H3
taaaaaaaaaaaaaaaaaaaaaaaaaaaaataaaaataaaaaaaaaaaaaaaaaaaaaaaagaaaaaaggaaattttaaaaaaaaaaaaaaaaaaaaaaaaaaaaaaaaaaaaaaaaaaaaaaaaaaaaaaaaaaaaaaaaagggccccccctttaaaaaaaccaaattttacttccccttcattccaaattaaaaattttttaatatggccaccaaaattaaattaattgccccttttttaaaaacttctaaactgaaaaaaccctgccttacccaaattaaatccctttaaaaaaaatccccttttcccaaatttgataaataacaaaaaaccccccaccatatccccttccaaaaattttcccacccttaatttcaaaattaaccccccctt

SEQ ID NO: 78077 - DNA, 410 bp, Zea mays
  Clone ID: LIB3079-011-Q1-K1-A11
tataaaacaagccagttttcttggtgagcaaggggagttcattgccagtggaagtgatgggggtagatggttcatatgggagaagagaacaggaaggcttattaaaatgcttgcaggggacggagctgttgtgaactgcatacagtctcatcccttcgactgtgccgttgcaacaagcggaatcgataacacaataaagctatggacacccgatgcaaatgctacatcaatggtttctggacctgaacttgatgtattgagtgccatagagaataatcagcagaagttatgtcggaaccgtcactttgtactatgcatgagttttcagaaggtttcgagtgtgcccagagctgatttactatcgctggagctgcttgaagaaaagggtaatacttggaagaatgatatca

SEQ ID NO: 78078 - DNA, 397 bp, Zea mays
  Clone ID: LIB3079-011-Q1-K1-H4
cccacgcgtccgaagcaggacacgaggatgaacaagtcgagctcgagcggcgtcgtggcggaggcggacgcgcatcagtgcgtgaacgcgcgcgcggacgacttcatcaacaagttcaggcagcagctacagctgcagcgactgaactcgctgctcaactacaaggagatgctcaaccgcggcggtgacaagcagtagccggagcgtgcaaggcggagggagaagggtagctagctgtaggatccaatccaaaaccatactgaaaaaaaaatcgatctttggtccatcaaccactagacctcgagtgtggattatgcagtgttgttcttattagcatcgttatgtaagaatcgctattttttcagcttgttaatttcaattggtttgtgttgctggc

SEQ ID NO: 78079 - DNA, 392 bp, Zea mays
  Clone ID: LIB3079-012-Q1-K1-G10
tcaatgacctcggagattgagaatgggaaggaactggaggacgaattggccaggacgcatatcaatggagacagcagtggccggaattgcagcggggacgacaaggaggcgagggtgccacttccctgggagctgctccagccagtgatgagggttcttgggcactgcttgcttgccccgctgaacccacctgaggtgcgtgatgccgcagcagacgcagtgagggtcgtctatgcccgtgcatgccacgatcttgtggcacaggcaatcttagcatcacgaagcttgattgagcttgacaagagcgcacgaaaggctgccaaggcagcagctgctgcggcttctgggcaaattgttgcagttggcactgctggaagcaatgcatcaagctc

SEQ ID NO: 78080 - DNA, 294 bp, Zea mays
  Clone ID: LIB3079-012-Q1-K1-G12
ccagaaagtactgaaccttattaatttggtagcttaaatcgttaccttatgttctcttggtgtgtgtggtgtgtcaatgtttttaaggttctcttggtgtgtgtgtgtgtgtcattgtttttaaggtgtcgccaaggcgtccaaaaatcataggcgccttgctcgcctaggcgtccagtcgataggccaacgtcttatctcgacttatgctttaagaaccatggtttgtgtatgctacgttgctactatggattctttgccttgctaggtttggaataaaaaaaataacattac

SEQ ID NO: 78081 - DNA, 445 bp, Zea mays
  Clone ID: LIB3079-013-Q1-K1-B1
gacgccggcgaggaagcggctgatgcgggacttcaggcgcctgcagcaggacccgcgcggcgggatcagcggcgcgccgcacgacaacaacatcatgctctggaacgccgtcatattcgggccggatgatacgccgtgggacggtggcacgttcaagcttaccttgcagtttacagaagattacccaaacaagccaccaactgttcgatttgtctctaggatgtttcatccaaatatatatgctgatggaagcatctgtttggatatcctacagaaccagtggagtcctatatatgatgttgctgcaattttaacttctatccagtccctgctgtgtgatccaaacccaaactcccctgcaaactcagaagcagcaagactgttcagcgagaacaaagcggagtacaaccgcaaagtccgtgagatcgtggagcagagctggaca

SEQ ID NO: 78082 - DNA, 305 bp, Zea mays
  unsure at all n locations
  Clone ID: LIB3079-013-Q1-K1-E10
aagcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtcggtgggcgcgaacatctncggcgggcacgtgaaccc

SEQ ID NO: 78083 - DNA, 355 bp, Zea mays
  Clone ID: LIB3079-013-Q1-K1-H4
aagcaagcagcctaaaaaaaccgtatcgtctcgcctgttcagtttccttctcctcttgccggagcccggtttgccgaccaggttccaccgttccagagtagccaagcgaatcccgtgtctggttcgcgcgatggcggaggagcagtccaacccccagcaccagcaagcggaggagagggaggttatggtggagcagcagcagccgaggagggccccgaagctgaggtacctggacttcgtccaggtggcggctgcccaggccgcggtgtgcctcgctgggctctacggcctcgccaaggaccacgccggcccgctccgtcccagcgttgacgccgtcgagtctgccgtcaagggc

SEQ ID NO: 78084 - DNA, 424 bp, Zea mays
  unsure at all n locations
  Clone ID: LIB3079-014-Q1-K1-B10
tataatctctcttcgtcactagctcgttgtaataagggaagcttgatcatcgttcctgacngcggtgatgaagagcagcacaatcgtcgcgcttctgttggctgttgccattctgtcctcgctgtctccatgctacgaagccggcggctgcatcgggaaacccaagaagtcaccgccgccgccgagaaggccatacctctcgtcctattccgaggaccaccagaactgccgcttgatctgtagctcgaagggtttcaaggacggtggctggtgtgacgaaagcgtcgagcacaaagtgtgctgctgctcccattagaaatataatatcgtatgttatgttgatgcatatatatgcattatccatctacctgggtggtgcaaaattctgaaataaatctacctgtgtggtgcaaaattcttaacc

SEQ ID NO: 78085 - DNA, 247 bp, Zea mays
  Clone ID: LIB3079-014-Q1-K1-B9
aaaaaaaaaaaaaaaaaaaaaaaaaatttaaaaaaaaaaaaaaaaaaaaaaaaggaaaggaaagactgccgatctataagcatccaaacttacatatcgcgtccatccaacattcataatatattcaatcgagaaacactaaatcaaatacgattggcacgtcattttacaacgcacgcactggcgaaaaccactggcagtatacccgaacttacattgcctttcaccactattcccctttcgccag

SEQ ID NO: 78086 - DNA, 378 bp, Zea mays
  Clone ID: LIB3079-014-Q1-K1-F10
cagcagttacctttggtgcatttgttgtgcacaaaacatcaaggcacaacaagtacaagaacttgtgctaggaaaccttgctgcctactctcagcaacagcagtttcttccattcaaccaactggctgcattgaactctgctgcttatttgcaacaacaactaccattcagtcagctagctgctgcctacccccagcaatttcttccattcaaccaactggcagcattgaactctgctgcttatttacaacagcaacagctaccaccattcagccagctagctgatgtgagccctgttgccttcttgacacaacaacagttgttgccgatctacctgcacgctgcgcctaaagcttgcacccttttacaactgcaaca

SEQ ID NO: 78087 - DNA, 420 bp, Zea mays
  Clone ID: LIB3079-015-Q1-K1-D11
tactgccgctgcagcattgtcatccccagcaagtacatctgccaaggctccagatcctgctcctgcacctgcgcccgaatcggttctcccacctctatccgaagatgagcagtggaatctgtacaaatggattctggaagaggagcggaagatcaaaccaccaacgccactgagaagaagaagatcgacgaggagaaagctcttctcaaggagataattcgggacaaatctctccctcgtttgtgatggttacatcggctgtccttctgatcttgattttttttcttctctctccacctgcagtccattgaggacaacatctgaaactatgtgccctgttagttagcaaaaccgttagcatttctttgcactatcacatctcttcatttgacaataagaaggtcgagttgttttgctctg

SEQ ID NO: 78088 - DNA, 65 bp, Zea mays
  Clone ID: LIB3079-016-Q1-K1-C1
aaaaaaaaaaaaaaaaaaaaaaaaaaaaaaaaaaaaaaaaaaaaaaaaaaaaaaaaaggaaaagg

SEQ ID NO: 78089 - DNA, 285 bp, Zea mays
  Clone ID: LIB3079-017-Q1-K1-A3
gtatccctaatcccacctccagtctttgggcaccaaatttccggcggcgatggcgggggctgtggcgaggtcagggttccggcgcatgttctccgtctctgccttcgcgccgccgaaggcgcccgccgcgcgccccaaggccgacccatcccccaacctcttcgtctccggcttaagcaagcgtaccacaagtgaaggacttagagaagcctttgcggagtttggtgaagttttgcatgctcgagttgtgaccgatcgtgtcagtgggttttctaagggatttgg

SEQ ID NO: 78090 - DNA, 294 bp, Zea mays
  Clone ID: LIB3079-017-Q1-K1-A4
taagtcctataggctcccagactcccttgcaacaaggactccagctccaatgagatgggtcagctccaaaacagaaggatccatcaaagccatcgaaggtgtcaaaggccataggattgttttctgcctccagccctgcaaagccacatacgtcaatcagaacttctcgcagcaggtgctgctccgcaatggtgagaaggtcacgttcgacgagcctaacccgtttgccactgaaggggaggaagctgcttccgttgcttaccgctaccgtcgctggaagcttgatgaggagac

SEQ ID NO: 78091 - DNA, 313 bp, Zea mays
  Clone ID: LIB3079-017-Q1-K1-A6
taagtcctataggctcccagactcccttgcaacaaggactccagctccaatgaatgcgtcagctccaaaacagaaggatccatcaaagccatcgaaggtgtcaaaggccataggattgttttctgcctccagccctgcactagaggctgcgatggcagctgctgtcaaggtggctgacgcggaggcaaaagcacatgatgcgcatgatcagacgatggaggcagaaaggatcttcaagatggccgaggataccgagtctctcctcataattgcagcagagatctatgatcgatgttcaaggggagagataacc

SEQ ID NO: 78092 - DNA, 366 bp, Zea mays
  Clone ID: LIB3079-018-Q1-K1-G9
cacatgtacaatagaccatcgggacagtcatatgttcctgtatctcttcggtgacactgccaaagttttgtttgtgattttgttcccgtgctatccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggtaaacgttataaaggatccaaccttaagcaacccaattatgcaacgtaataaatcttttttactggcaccaaaatcaaattaattggccgtggtttaacaacatctaaactggaaaaaccctggtgttaccaaactaaatacgcttgcactaaatgccctttt

SEQ ID NO: 78093 - DNA, 404 bp, Zea mays
  unsure at all n locations
  Clone ID: LIB3079-020-Q1-K1-H3
aagcatacaggtgagagggagaggaccgagggagagaggagagagagcgatcgagaggggaggagggagcttgcctcccccttagctactgccgccgctgccacggccggtgcctcctcctcggctgccgtctcgctccggggctggtgggacgatgtcaacgagtcgccccagtggcaggacggggccttcttctccctcgccgacgcctacgccctcgtctccgccgtcgcactgattcagctcgtcaggatccagcgccgggtgcccgagttcggatggaccacgcagaaagtcttccacctcatgaacttccttgtcaatggggtccgtgctctggtgttcggcttacatgtccatgtctatctccttcgcacaaaagtatacaangtggtgttgctaga

SEQ ID NO: 78094 - DNA, 365 bp, Zea mays
  Clone ID: LIB3079-022-Q1-K1-B7
ttcagctgttatgacgattgtgcctggtcttggcaagaaggatgtgtacggggcagatcttcccctagcacatatccttgaattggcagctgaggcaatcataactggtgttggggcttcaataggttacgggtcacctttgaccctgactgatacatcaaataaaataaaaaaggggacgcaaggtgatgcttctgtactgaagccaacgctaatgactgctgtacctgctatacttgatcgtgttcgtgatggtgtacgaaaaaatgtagatgcaaaaggtgggttagcgaagagattatttgatattgcctatagccgtcgtctagctgctgtcaatggaagctggttgggtgcgtggggac

SEQ ID NO: 78095 - DNA, 379 bp, Zea mays
  Clone ID: LIB3079-022-Q1-K1-D4
cggaattccggtgaccacgcgccgcgaaagtcacgacatcccattctgtatatccaacagtggcgaaagatacgagggtgaagaaaaggagtgggtggaatccactggtgtgtcaaatggtgattttgtttcttatgtgaacgagtggtgcaaagacggggctgtgcttatcggtggctgctgcaggacaactccaaacactatcagggccatacacagaactctgaacaaaagccccaacaagcagcagttacctgctgtagaataagagctgtgctctactctgatgcgcccgccttcctcctagcagtacctcgaggctataactccatgattccgtaaccgtacgtgttcgttctcttgcaaacgagatgtttgt

SEQ ID NO: 78096 - DNA, 316 bp, Zea mays
  Clone ID: LIB3079-022-Q1-K1-D5
ggacactcctctgaaaactcgaagggttatcaagctgaggaaggtgctcaacacaacggaggagaccaagatcactggtgccaatgctttcatgaaatcacatgcccctcttgtgcacctgtccgcgcttccagaaagcaccgttgtggactcgagatagcgacctctactccgaatttactttcagctcttgcatgtttgtggttgtggccatcatgtactgattttcccttttcaacaattgtcgtgaagctgtatcctcttgaataaaaaaaaaaaaaactaaaaacccgcccctattattaaaattacctgg

SEQ ID NO: 78097 - DNA, 295 bp, Zea mays
  Clone ID: LIB3079-022-Q1-K1-F11
cccacgcgtccggaggagcttcagtgctgtatgatgtgtaaactatttagtgtaagttgtaaccaattgttgtaagttgtaaccagccactatgttataatcctgtttgtttcagcttttaaaaaaaaaaaaaaaaaaaaaaaaaaaaaaaaaaaaaaaaaaaaaaaaaaaaaaaaaaaaaaaaaaaaaaaaaaagtacgcctccaaaaaacgtcataacttttctataatgaaccctaaattcaattaactgccacttcgttttacctcgtttttattaggcaaaaccctgttg

SEQ ID NO: 78098 - DNA, 363 bp, Zea mays
  Clone ID: LIB3079-022-Q1-K1-F12
cccacgcgtccacaaatcatttacttccctgctaaggctattctcagatgcaaaaagaaaaaaaaaaaaaaaaaaaaaaaaaaaaaaaaaaaaaaaaaaaacaaaaaaaaaaaaaaaaaaaaaaaaaaaaaaaaaaaaaaaaaaaaaaaaaagggctgcaaaccaaaaaaatcaaaacttacattcacatgcatgccacttctaatctatcaaatattgccccctaaataaaattcaatgcccaccattttaaaacaacgtaaatggaaaaacccttactttaccaaacttaatcgcctattaaaacatcccattttccccaatttgattaattttcaaaatgcccacaccaatcccccttcc

SEQ ID NO: 78099 - DNA, 377 bp, Zea mays
  Clone ID: LIB3079-023-Q1-K1-G9
tagagagcgaggatgtcgagccggaggccgtcgtcgcgtggcaacatctccgaggacgagatcaacgagctcatctccaagctgcaggccctgctccccagctcccgccgccgcggctccggccaggcgtcgacgacgaagctgctcaaggagacctgcagctacatcaagagcctgcaccgggaggtggacgacctgagcgaccggctgtccgacctcatggccaccatggaccacaacagccccggcgcggagatcatccgcagcatcctccgctcctgatcgcccacgcgcctcctactgcggcggcgccggccggcgcgcgagagagcgaggtcggcgacgacctcgatcgccgacaacgacgaccgcgcgcg

SEQ ID NO: 78100 - DNA, 403 bp, Zea mays
  Clone ID: LIB3079-024-Q1-K1-C8
taaaacacaataaaacataaaaacaaaaacaaaaattaaacataaaaaaaaaaccaaacttacatacagaaacatatcaaccacataactctcatataatatactcctaaattcaattcacttcaccctccatatacaacctcttaatctaaaaaaacccttccattacccatcttaatcaccttgcatcacatccccctttcaccaccatacatactaactaccacgtcctcacctatcttccttcccaacaattgcacaccctcaattgctaatgcgactcccactgtactctcgcattaatcaccctcgccatagtggttacgctcaacctgaccattccactctccatctccctatcgactcatcctttccttttcttcccttcctttcttctcacgtt

SEQ ID NO: 78101 - DNA, 407 bp, Zea mays
  unsure at all n locations
  Clone ID: LIB3079-024-Q1-K1-D3
tacacggtctncctcttcctgtcagtagtagagtgagagtgaggcagcgagtatgagacaagggggaatggggaagggagcgcaagggagcgatgcggcggcggcgggcggcgaggtggaggagaacatggcggcgtggctggttgccaagaacaccctcaagatcatgcccttcaagctcccgcccgtcggcccttatgatgtccgcgtgcgcatgaaggcagtggggatttgcggcagcgatgtgcactacctcagggagatgcgcatcgcgcacttcgtggtgaaggagccgatggtgatcgggcacgagtgcgcgggcgtggtcgaggaggtgggcgccggcgtgatgcacctgtccgtgggcgaccgcgtggcgctggagccgggcgtcagctgctggcgct

SEQ ID NO: 78102 - DNA, 456 bp, Zea mays
  unsure at all n locations
  Clone ID: LIB3079-024-Q1-K1-D5
gacggtcgtgcccacgcctccgcgctcgtcaacgtccacctctcctgcaggaacatgccggcgatggatttgggggtgctcaaggatatgccggggatccgcgataaggcgaactccaagttggcgcttagagaggagcaatacagcggcatgcttctgtcggcctacaaggagatgttttctgaccgccaagataatttgaatgattcaggggatggtggaggagccccagtattcaaatggttctccgtattagaatttgagagtcttgcccaggagcttgttcagatgtttgtttcagagcaaaagttgaagaggctgctactcttggaatttctctcgattgctttaaaggaaggtgtagaactccagacatcattaaattggggtgatgaactatatgatggtgaatcanataaacttcagagtatnggccttcagtcaggagatgcctac

SEQ ID NO: 78103 - DNA, 313 bp, Zea mays
  Clone ID: LIB3079-025-Q1-K1-E10
aaaaaaaaaaaaaaaaaaaaaaaaaaaaaagaataaaaaaaaaaaaaaaaaaaaaaaaataaaagtaaaattacaaaggaaaaaaaaaaaaaactcctccactttatccaatcctactttccctacccttccatccaaccttttttctcttctttaacttcccctcaattcacttcactgtccttcattatacaacttcttacctggcaaaaccttttctttacccaatttaacctcctttcatctcatccccctttccccatctttcttattcccaaacatccccgaaccgacctccctttccaaccttatc

SEQ ID NO: 78104 - DNA, 273 bp, Zea mays
  Clone ID: LIB3079-027-Q1-K1-C1
tacggatcaaggtccggatgaatcaatagaccagaataaaaccaaggcatcgccaatgtaccatggccatcattgatttcatcttggtttgctcaatcgtgtcatgaaaaaaaaaaaagaaaaaaaaaaaaaaaaaaaaaaaaaaaaaaaaaaaaaaaaaaaaaaaaaaaatggggacacgaacccaggtgctctaaaattagaacgaccagctgccaattcaaagcctatctcactgagcatctagaatcaatactacatgcgcaggataaa

SEQ ID NO: 78105 - DNA, 155 bp, Zea mays
  Clone ID: LIB3079-029-Q1-K1-A5
aaaaaacaaacaataaaaaaaaataataaaaaagggcagacgatctaatagatccatgcttacttccgcgtgcatgcaacgatataggctctactatagtgcaacctaaatccaatccactggccgcaggcttacaacgtccaaggctggcaaaa

SEQ ID NO: 78106 - DNA, 355 bp, Zea mays
  unsure at all n locations
  Clone ID: LIB3079-029-Q1-K1-C2
taacagggatgagaaatcagaaaggcaggtcaactacatgaaaaaagaaagtgggcctgaaattagtcggactggtgttaagcagcaacagcaacttaaacagctgcaaaggccatcatcaacctcatcgtcgcaggttttatccaagcaatctgagaaggaagatatggaaataaacacaatacttgaggaagaggcgctgatagcagctcacagaaaggaaattgaaagtacaatggagatagtacgagaagagatgaatctattagcagaggtcgatcagccaggtagtcttattgacaactacgtggcacagctaagctntctgttgtcgcggaaagcttctggtttggta

SEQ ID NO: 78107 - DNA, 331 bp, Zea mays
  Clone ID: LIB3079-029-Q1-K1-G4
taccatctcaaacaaactggcccatacaccttttcttgtcagaagcttggtcagatattagtgcggatttatggtgaaaattcagagcttttaccttcagtattattatcattgagtggcgagaaagggtacagaaataactcaattagtagttctggtggaaccttcacctttgacaacttatttcctggaagtttctatcttcgagcacttctaaagggatattaatttaattcgtcaacagtagctattgagcttaattcttgagagatttaggagggttaatttcgtgcaaacagagtggcttacactgccataggttttgtgacac

SEQ ID NO: 78108 - DNA, 441 bp, Zea mays
  Clone ID: LIB3079-029-Q1-K1-G6
tatcgaatggttgatctggcttcgaaaatcagttggttttcaagattttcgctttgatttcacgaaaggttatgcagccaagtttgtaaaagaatacattgaggaatcaaaacctctttttgcagttggggaatactgggatagctgtgaatatagcccccctgactaccgactgaactataatcaagatatccatagacagaggattattaattggatagataacactggaggactttgtgccgcatttgatttcacgacaaagggcattcttcaggaagctgtcaaaggagagttgtggcgtttgcgagattcagaaggaaaaccacctggtgtgatgggatggtggccttcaagatcagttacatttattgaaaatcatgacactgggtccactcaaggtcattggccttttccgtcagatcatattatggaaggtgt

SEQ ID NO: 78109 - DNA, 439 bp, Zea mays
  unsure at all n locations
  Clone ID: LIB3079-029-Q1-K1-G7
gtgaggaaccggatgaagagtgtcaggaatatccagaagatcacaaaggctatgaagatggttgcagcatcaaagctccgggcagttcagacaaggactgaaaattcacgtggcttgtggcaaccgttcaccgcccttcttggggatgctcctagtgttgacgtcaagaagaatgtgattgtggccattacctctgataagggactctgtggtggtattaattcaacatcagtgaaagttagcagggcccttcacaaattgacatctggtccagaaaaagaaaccaagtatgttatattaggagaaaagggcaaagttcagctgttgcgtgactcaaaggacagcattgaaatgactgcaactgaactgcagaagaccctatcaactacacacangttgccgtgctcgcggatgacatattgaaaaatgtggatatgat

SEQ ID NO: 78110 - DNA, 409 bp, Zea mays
  Clone ID: LIB3079-030-Q1-K1-A11
tacaaagtgatctatgatttgattgatgatttacggaaggccatggaaggtcttctggaacccgctgaggaggaagtaccaattggttcggcaaaagttcgagctgtctttagtagtggcagtggaaaggtggccggatgcatgattacaacaggaaaagttgttcaagattgtaatgtgcgggttcttcgtaaagggaaagaagtatatgtgggttcgcttgattccttgagaagggtgaaagaaactgtgaaggaggttggtgctgggctagagtgtggtattggggtagatgacttcgatgaatgggaggaaggtgacatcatagaggcattcaataccgtgaataagctgaatggtgagctgaagctattgtgctgaagctgttgtgagctggaccggtggaccg

SEQ ID NO: 78111 - DNA, 356 bp, Zea mays
  Clone ID: LIB3079-030-Q1-K1-C12
taatctctcttcgtcactagctcgtggtaataagggaagcttgatcatctttccttgacggcggtgatgaagagcagcacaatcgtcgcgcttctgttggctgttgccattctgtcctcgctgtctccatgctacgaagccggcggctgcatcgggaaacccaagaagtcaccgccgccgccgagaaggccatacctctcgtcctattccgaggaccaccagaactgccgcttgatctgtagctcgaagggtttcaaggacggtggctggtgtgacgaaagcgtcgagcacaaagtgtgctgctgctcccattagaaatataatatcgtatgttatgttgatgcatatatatgcat

SEQ ID NO: 78112 - DNA, 400 bp, Zea mays
  Clone ID: LIB3079-030-Q1-K1-E1
tatttacacagttggcaaccatggtttctcaacagggagagctagcaatcagaattgacgagaacatggaggaaacagtggctaacgtggagggagcgcagggccagctcctgaagtatctcaacagcatttcgtccaacaggtggctgatgatgaagatattctttgtgctgatggtgttcctcatgatcttcatattcttcgtggcttgaccttctgtaccattctgcccgaggtgctctggccgctatgcgtagtattcttttatttttactcatactacaccgtgtacacaattttcaccctggacgataagccatcggtcacccttttgtggccatgtaaattgggaagagttcgagtcctgttacgttactcttgattggcaatatcttcactg

SEQ ID NO: 78113 - DNA, 429 bp, Zea mays
  Clone ID: LIB3079-031-Q1-K1-E11
tccggcgagatggggatgcgagataagaagcggaaccagaagcgagtgctcgcgcgccggaccgcggcaccgcgcccaggcgagggcaaggatttcctgccgctggaaggaggccccggtaagaagcatctgaaggtgcagcagcctgaagagcccgaaaacacagccacaatcgtctacattgggcatatcccccatggtttctacgaggacgagatgaaagggttctttaagcagtttggggatattaagaggcttaggatcgctcgtaaccgcaagacaggaaagtccaagcactatggattcattgagtttgagaaccctgctgtggcaaaggtcgtagcagatgagatgaataactatctcttgtttgagcgcaccttgcaagttgcacttgttgagccagagaaagttcatcctaaattatgg

SEQ ID NO: 78114 - DNA, 381 bp, Zea mays
  unsure at all n locations
  Clone ID: LIB3079-032-Q1-K1-F10
cccacgcgtccgcccacgcgtccgcccacgcgtccgggcgtccaccgatggcatccgcagcatccccaccgtgctcatcttcaagggcggcgagaagaaggagagcgtcatcggcgccgtcccaaagtccacgctcaccaccctcatcgacaagtacatcggtagctcatgagcatgccatgcatgcatgcatcgacgactaaacacatatgtgtatctctagtagcctttgcatacgggatatgatcaattcaagcagccagccgtctgctactgctgngttatatataccatacctncatgtcgaattccgaggacctttaataggttcaagtcacgaattccaatcagtatatatatatcaatgcctctgggtggatt

SEQ ID NO: 78115 - DNA, 390 bp, Zea mays
  Clone ID: LIB3079-033-Q1-K1-A8
tacattcctcagcaagattacttctcagagggactctacacgttcgatattgggcaggatgaccttgctggtgagttctattcaagaacagaggaccaggtcatcgcatccattccaactattttgctggaatttgagaatggtctcaagaaactgtatgaccaaggtgctaggaagttctggattcacaacacgggccccctcggttgcttgcctcaaaacattgccctcttcggcaaagacccatcccaactggacgagctccactgtgtggcgaagcacaaccgtgccgcaaagcttttcaacttacagctgcacgcactttgcacgaagctgagggcagaattcgatggagccagcatcacttacgtggacattcacacgatcaaa

SEQ ID NO: 78116 - DNA, 339 bp, Zea mays
  Clone ID: LIB3079-033-Q1-K1-B8
aagcaatctcaagtgaatcaaaccgccagacttcgcagtcctcctccccacgtaccagggcatgcgcgttgccgcgacccgagccgccgccgccgctcaccctccgagcgccttcctgctcctcctgttactcctcggttgcgcgtccctcgcgatcggaggagcagccatggccggccacgtcctcggcggcgtgaaggagaacccagccgcggccaacagcgccgagtccgacgggctcggccgcttcgccgtcgatgagcacaacaggcgcgagaacgcgctgctggagttcgtgcgcgtggtggaagccaaggagcaggtggtggccggcacgct

SEQ ID NO: 78117 - DNA, 349 bp, Zea mays
  Clone ID: LIB3079-033-Q1-K1-E5
aagcggttggcatcacttgagatggagtttgctgcagcaaagcataaaggttttgttggcaaatatactcctgagacaaatggaactcattctgggaaaaagccactgattgttattggaataatgagtagctttgggaggaaaaactaccgtgatgctgtcaggaaatcatggcttccaacaggttcaatgctgaagaaactagaagaagaaaaaggcattgtagtacgttttgttgttggaagaagtgcaaatcgaggtgatactttcgatagggagattgatgacgaaaataggagcaccaaggatttcttgatattggatgatcatatagaatctgatgaagagc

SEQ ID NO: 78118 - DNA, 354 bp, Zea mays
  Clone ID: LIB3079-033-Q1-K1-H2
agcacactaagggtgtgctcgcagattttccattggttggtcctatagattgcaagtagatatggcactaccatcgactaaacccgactcagtacataatgtactgcatgaaagtgtatgacaaaatactgaacaataacaacgtttagtcatgcactcaaacaaagtcgacacttgactcacaaaaagtatagaaagagctatatcctgatgagccctacgaatcggacttcacaagaacctacgacactgacgctgatgtcaaccctgcatgatcagacgatgacattacctatgatctggtctcgactgttaagagacaatcctatttctatcatcaagctggaacaccaa

SEQ ID NO: 78119 - DNA, 284 bp, Zea mays
  Clone ID: LIB3079-034-Q1-K1-H4
aattcactcaaacctcttccccaaatcttcgtttagattctcgttgacaagaagactggaacggaacctgaccatgtcgctgatccgccgcagcaacgtgttcgatcccttctccctcgacctctgggacccctttgagggcttccccttcggctccggcaacagcagcagtctcttcccctcgttcccgcggaccagctcggagaccgcggccttcgctggcgcgcggatcgactggaaggagactccataggcgcacgtgttcaaggccgacatacccgggc

SEQ ID NO: 78120 - DNA, 399 bp, Zea mays
  Clone ID: LIB3079-035-Q1-K1-D6
cagctatgtttgccataggctctcatgctgatggatactgtgagaatgacctccaaagcctgatgggtgactgcaagacatacgtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaggttgtgtatgttgctgagcagtgtaagaggccatttgagcatggcttccagtgcggaagctacaaggttccagcaaactgatgatatcgcaagagggaagcgcttgacgtaagctttagatttcaattgctgcagccgatcaacctttttagggttgtataatatgaactcaatgttgagactaatg

SEQ ID NO: 78121 - DNA, 378 bp, Zea mays
  Clone ID: LIB3079-036-Q1-K1-G7
tacagatctactatagcaggctagctacgagtttctcatacaaatatcatgccacagctcgagggactatgtgggaaacgtgcatcaaaacctactgctcatccaacactgtgcctccgtgataggcaactagctgcgcaatttcaggaaatccctctggatcttacgatgatccgggcacataaggctggatttgagatcctgaaatctacgattgctgagaaactacccaatgatctgtaaggaatagagtgctcaatggagaagctctacattcttatcgatgagatctacaaatacacccatgatgtcgtgtaaggacgcgttgcacctgattacacaatctcacaagcggtctctgaatctgtagcttcaatg

SEQ ID NO: 78122 - DNA, 449 bp, Zea mays
  Clone ID: LIB3079-036-Q1-K1-H3
cacggttttcttcttgtggcaactcagcattgcctactcagaagagccttgttcctcaaacaaagcctctcgcagaccctcagcaattagcagcaagcaggcctaaccagtcacaaggaacaaaaactgatagagcaagtgcacaagcatctgcaattaaaaatgaaggttcacgatccagatgcaataaagctaccattccccattcgagaaacaaaggcagcaagaagacgcaacagcaacctaatggacgtgttcatgcgatcaagttcccagtagagtagcccattcgtaggtaatttattggttaagtggaagtgtctcttctggtgaacagtctcttcttttctcctttccaaatgaaattggttattgtcaggattgttctaatttggactgtcccgatccgaggttttggttcgccggccattggtactagaaagctacag

SEQ ID NO: 78123 - DNA, 304 bp, Zea mays
  Clone ID: LIB3079-037-Q1-K1-A11
cccacgcgtcctagaaaggagtagaacaggagttcgatggtgatgaggaagctgaagtggctggatagatcgagagagtgtttacaggttttgagggtcaacacagcctgatgttatagcaacttcgcacgtacggtattgccgatcctgatgtatgcaggaggcaggcttatatagcagaggcgtcaatagtctgaaataacatccgttgcactagtatccgaataaagtgacagtgaattgattttttattttcattaaatttctgtgtaaaaaaaatatactccaagcccgatgatgtaac

SEQ ID NO: 78124 - DNA, 420 bp, Zea mays
  Clone ID: LIB3079-037-Q1-K1-B5
aagcaacctgggccgggaagatacattaggctcgtgtcacgttggtttcgtgctgggtgggttgacggtgtattggtcatgtattatgcatttgcgctggtgttcgttgctgtccaataaagatagaacacgttctcgccttttgttttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaacaaaaaaaaaaaaaaataaaaaaaaaaaaaaaaaaaagataaaaaaaaaaaaggggggccccttttaaggggcccaggtttacttccccgtatttccaacttaaaactttttttttggggccccaaaatttaatttcaggggccgggttttaaaaacctttatattggaaaaacct

SEQ ID NO: 78125 - DNA, 321 bp, Zea mays
  Clone ID: LIB3079-037-Q1-K1-B7
aagcggcctggcacacgaagatccattattcttctgctacatccgacaacctctgggggagtgaactttttatatggcacttgtaatacgtcacaaactcctatcatggcgcccttcactctatatgatacacggtcttaggcgatctcttactactccttttaatccatgtgcacaatacacctgctcaccagctaatgaacatggcgtacatgcctgttctgccttgcacacgactacacaccttcatgatcttacctgcgctctgataacaggttgctcgcctaaattacgatatgctcgatgtgcctttcttcacat

SEQ ID NO: 78126 - DNA, 360 bp, Zea mays
  Clone ID: LIB3079-037-Q1-K1-E9
aaaaaaacaaaaataactaacaaactatacaatacataactcaggccttctaaacatccaggctgacttacacatgcgggcgacttcataactattctatactaccacctaacttcaattcactgcccacctttttacaacatcatcactctaaaaaccctgtcattacccaactaaatccccttacaccacatccccctttatccaattaacattataacgaatatccctccaccaatctccctatcaacacttccccaaactaaataacgaattagactctccctttaaccgatcattaacctcaacatgtcttgtagttacacgcatacttacccctacacttgcaatcaccctaac

SEQ ID NO: 78127 - DNA, 367 bp, Zea mays
  Clone ID: LIB3079-038-Q1-K1-F2
aagcgaatcacattatcaacaacctatcaacaatggctaccaagatattatccctccttgcgcttcttgcgctttttgcgagcgcaacaaatgcgttcattattccacaatgctcacttgctccaagttccattattacacagttcctcccaccagttacttcaatgggcttcgaacacccagctgtgcaagcctataggctacaacaagcaattgctgcgagcgtcttacaacaaccaatttcccagttgcaacaacaatccttggcacatctaacaatacataccatcgcatcgcaacagcaacaacaattcctaccagcactgagccacctagccatggtgaaccctgccgcctacttgcaaca

SEQ ID NO: 78128 - DNA, 278 bp, Zea mays
  Clone ID: LIB3079-038-Q1-K1-F5
ggcaaaaaaaaatgcggcgagccgttttaaaaagaacccagtttacttgcgcgttcttgcacaaatattatctttcctaaaacgccccctaaactcaattcactcccctttgtttaacaacgccttcacggaaaaaaccctgtcttcaccaaatttaatcccttttccccacatcaccttttccccatctgtattaataataaaaacccccccaaatatcgcccttcccaacaattgcccacctttaataccaaatgggacccccccaccatgactac

SEQ ID NO: 78129 - DNA, 197 bp, Zea mays
  Clone ID: LIB3079-041-Q1-K1-H8
tacgagtttcagaaatataatcaagaatctggtggtgaggtgcatattacttagcctaggatacaggtgatagttcgtcaaagtttgaaggccatgattaattggccccgcatgaggatcatcaatgagaccctaatcctgatactattcggatcaatagctacaagatacgtgtaattaaagtcattgatcatgga

SEQ ID NO: 78130 - DNA, 283 bp, Zea mays
  Clone ID: LIB3079-045-Q1-K1-A7
aaaaaaaaaaaaaaaaaaaaaaaaaataaattaaaaaaaaaaaaaaaaaaactaataggagagcatatataaaacaatctaaagaaaccaaactaacatacccttgcatgctactaaataactcttatctagtttcaccaaaattcatttcattggccgtcgtttaacaacgtagtactctgataaaaccctgtctttacataccttaaatcgccttgctacaaatccccattttgccaactggcttaatttcaaaaaggcattcaccgatcgacctttccat

SEQ ID NO: 78131 - DNA, 191 bp, Zea mays
  Clone ID: LIB3079-045-Q1-K1-C5
gagcagtgccagcgagttgtgaggacctctttctgtgtggaatgtggcgaggaataagctgagtcttttaagggggtgcttcaggtgtgcgtgtttgcgttccttctgactcggtgtctgattaccaaattctatctgatgtatccgcttcagtttcgaattaaccatgccagaagcttttaatattttct

SEQ ID NO: 78132 - DNA, 271 bp, Zea mays
  unsure at all n locations
  Clone ID: LIB3079-047-Q1-K1-E9
taaagaccccancatcaatcgttctgttcatatactgcttcatctgtgtgtggtttctgggttttctatctttcttccacanccatcccaagagcacaaaccagatttgtaccctctcaactataataatatagttggattccacccgcacacatatagctgacaatccttaccttacacccaatgcatataacaattaatatctcattcctctaaaaagagagcctaaagccctatttcattttcacccattactaattctgattaaacc

SEQ ID NO: 78133 - DNA, 266 bp, Zea mays
  Clone ID: LIB3079-048-Q1-K1-H12
tcgtactcatgggctgactcatttgttttaaaaaaaaaaaaaaaaaaaaaaaagaaaggtaaaattataaaataaaaaaaaaaaaaaaaaaaaaataaaaaaaaaaaaaaataaaaatttaaataaaaaaaaaaataaaattaattatttttattttatcttatataaaaaaaaaacaattaaataaaattaaaaacttaatttctatttattatattttctttattaaattaaatctttttttataaataaattttttttttata

SEQ ID NO: 78134 - DNA, 262 bp, Zea mays
  unsure at all n locations
  Clone ID: LIB3079-049-Q1-K1-C7
tgccgtcttgctctccctgaggtcccgatccggcattctcgcntcgcgccgatggtatgccaaccttgctctcgaattttggcgaccccacattcccacggcgcttgaagaaatcctagccccgtgctgccgcgctgcagacggcacgcacggcatccatggagaacgacgcgaaggaggcgaggcaggggcagcacagggtgttcccgtgggggatgctcaaggtgttcctgctgctcggcttagggctgtccgcggccgg

SEQ ID NO: 78135 - DNA, 434 bp, Zea mays
  Clone ID: LIB3079-054-Q1-K1-D6
tacaatttatattcaatattaaaaacatcttagcatgatgttctactggttagacagctggacccagtgtctttcgtccttcttccatcaggacatgggttcgaaccccacgcgtgcgtctagcctgtgccggtcgccgtttggccatctatatagacgtgcagcagattaatttgaaatagctgaggggttattttaaaaagatgacgcatgatgaccgttgaaattggtgctttaagtatagtatagaattcttggaaggttttgctattctacttatttgtgatacataaacttgcccattttttcttggtatctactatgaacttaactgatgcatttgataatataatgatttcttttgagcctgttcattagatgtaaattaacacagtatccatttacaaccaattcttttgcatttttacaattga

SEQ ID NO: 78136 - DNA, 349 bp, Zea mays
  Clone ID: LIB3079-054-Q1-K1-F1
tagctctctatcaagcatccggcggagcgagcagcggggggctcggcgagagagaagatgaagcggaagacgcggaacaagatcatcgtatggacgctggccctggctgcagtggcgattctggtgggcggcacgattgcgctggtgctcacggcggggacgtggaaggccaagataaagaagtcgcaggagaagatctgtaacaaggggtgggagtgctcggggagcaagtactgctgcaacgacaccatcaccgacttcttcaaggtgtaccagttcgagaacctcttcgccaagcgcaacacccccgtcgcgcacgccgtcgggttctgggactaccaggccttca

SEQ ID NO: 78137 - DNA, 345 bp, Zea mays
  Clone ID: LIB3079-054-Q1-K1-G5
cccacgcgtccggacgcctgcggacgtcgccgagaacttgacgcccaaggcacccggcggggacgctgactcgtgcctcgccgcgcttgtcgaggcactggagaaggctaaggaggacgcgctggcgaagaaggccaaggggaaggaggaggccggctccgcctatgagctcgactacgaggagtagctggtggctgctgttgacttcttgttagttgctagtgctacatatgtatggagcccctgatctaggtgctggtctcatctcatgagcgaagaataatgctaactagactacgatttgattattactttatgttgtcagatcaaaaactaaaagaacct

SEQ ID NO: 78138 - DNA, 368 bp, Zea mays
  Clone ID: LIB3079-055-Q1-K1-H9
aaaaaaaaaaaaaaaaaaaaaaaaaataaattgggccgccccttttaaagatccaaggctagggtccccttccttccaactcattactcctcttttatttcaaccaaattcaattcaattgcccgcgttttacaaccttcttacctggaaaacccctgcctttcccaaattaattcgctttcaacaaaatccccttttcgccacttgccttattaccaaaaaggccccacccatccgcctttccaaccatttccccaccctaattgccaattggaaccccccttttaccgcccatttaaccccgcgggttttgttgtttacccccaggttaaccgttcaatttgcaagccccttacggcccgttcttt

SEQ ID NO: 78139 - DNA, 380 bp, Zea mays
  Clone ID: LIB3079-058-Q1-K1-B7
tacacaacacacacacaaatactctccattttattccatctcaaaggataaaataatggtgtgtctctccaacaagcttttccgcttcctcctcctgctcgttcgatacacacgaacgcaatgcagaccgctgactatcttctccgccaggaagtcccaatctcatagcttccacttcaagggaccttactcgatggacgccaactgcgcaaacgtctgcctgaccgaatgtttcaccgtctgtatatgcaaagccctacgccaccgctacttctgcaccatggactgctaatactgcctaatctctccatccctcagctcgtgtcctgcgtgtgcatagccgcaccatatcagtaaaacatgcatgcatgcattaccta

SEQ ID NO: 78140 - DNA, 282 bp, Zea mays
  Clone ID: LIB3079-059-Q1-K1-C3
cacggcttcatcatcactccactagccagtcagctactggcctacagctagccgggtactgtcctctcatcccatcccatctcatctccgacaagcgaagcagagcactggcatgagcatggaccgcatggcgcggcgttccgtgtccttgctcctcgctctggctctcctggccgccgcggcgtctgcggactcgtggctgtacgagaaggtcacgacggaaggcaacgtgcgcgcggactacaacgcgcaagggcagcaagtgacgtctctgatcctgac

SEQ ID NO: 78141 - DNA, 297 bp, Zea mays
  Clone ID: LIB3079-059-Q1-K1-H4
gcagcttgagcgtgccgctgccgccagcagcagcctgtacgagccagctctgatgcagcagcagcagcagctgctggcagcccagggtctcaaccccatggccatgatgatggcgcagaacatgccggccatgggtggactctaccagtaccagctgcccagctaccgcaccaacccctgtggcgtctccgctgccattccggcctactactgattcatgatatttgggaaatctcctctatccatctctctctatctatatatgtaataatgcagtaagacgacacacattatcat

SEQ ID NO: 78142 - DNA, 99 bp, Zea mays
  Clone ID: LIB3079-059-Q1-K1-H9
gttgggagggtatttttattgcttggtggacgtatgacttctacctaaaccgttggccatttaaagtcaaacattaggtgcagaaacgaagcctatttg

SEQ ID NO: 78143 - DNA, 471 bp, Zea mays
  Clone ID: LIB3079-023-H5-R1A
caccggggaccctacccgagcatcagccatggcgatcgcgagcggcgtcctgcgccgcctcccgctccacctctacccctcgctcgctcgctctttctgcgcagtttccccggccgccgcctcggccgccccggcgtccgcctcggccgccccggcgtccgccaaggtcgccgatcgcatcgtgcgcgtcctcgccatcgatctcgagggggcgcgccgcgaggtcgtcggcctctccgggcagacactcctccgcgcgctcgccaacgcggagctcatcgagccggcctcccaccgcctcgaggatatcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgggctgccaggtcgtcctcacgccgga

SEQ ID NO: 78144 - DNA, 469 bp, Zea mays
  Clone ID: LIB3079-030-F3-F1A
aggcaaggcagcgcaatgctctcttaaagcagatatatgcggcaatggcgagctcagattgtagcgcgccatccgttccgtttctttcatgtacattacaaggctttctgctttcagcccagccaatttttccctccaccttaaaaccaagtttgctactccaacaaccgttgcgttgcggtcgccctagctagacgacgatttgggagcactgacggtttgaagcccccgccgggggcgcggggctactgcatccggccgacctgttcggcggcagcgcgcatgaagccgtccaccagctgcggcatgcagaggtcggtcgcgccaacggcgcgcagccggcgcgcaggcccgcgctcgccatgtaccgctgcacctcggtgcggatcagctgctgcatcgccgccgcgaactcggggctgaacgggtaggccgagggcgcgggtgtagagggcgacggcgggagctc

SEQ ID NO: 78145 - DNA, 470 bp, Zea mays
  Clone ID: LIB3079-030-F3-R1A
cggacgctggaggacgcgccgcccttcacggccgacgaggacgcggccatcgcccgcgcccacgcccgcctcggcaaccgctgggccgccatcgcgcgcctgctccccggccgcaccgacaacgccgtcaagaaccactggaactgctccctcaagcgcaactcggcgccgcgccgccgcgtccggttcggcggtttccgctgacgactccgccgccgccgccgagaccgaggcgcgccggggcaagatgatgatgatgagcatctcgccgcccgacagcccctcggggtcggggtcggggtccgaccgtagcgacctcagcagccacggcgccgggtccgggtccgggtccgggtccggccagatttaccgccccgtggccgcgcgctccggcgggttcgagccggcggactgcgccatgagccgtccgcaagaggaggacccgctcaacgccctcagcctctcgcttc

SEQ ID NO: 78146 - DNA, 472 bp, Zea mays
  Clone ID: LIB3079-031-H3-R1A
gaggaggagcacaggttgttcctcctaggcctgaagaaatacggcaagggggactggaggaacatatcgcgcaactttgtccagaccagaacgcctactcaggtggccagccacgcgcagaagtacttcatcaggctcaactccggcggcaaggacaagaggaggtccagcatccacgacatcaccacggtcaacctgacggacgaccagccgccctcgccgtcccagtcctccctgatcaccagccagtcgaacgcaccagctccatctccagctccggctccagccgcggggatatgccaggtcccattggcggccgacgtcaagcgacacggtgccggaactctgcccttcagctcaccgaaccggacctctgcggtaccggcctacaggatggagtttcatgaccaacaaggcctgcagtgtggccctctgcatgatcagttgctcggcagccagagcgtcctgttct

SEQ ID NO: 78147 - DNA, 471 bp, Zea mays
  Clone ID: LIB3079-034-B7-F1A
attaggttccaacagttattcccaaagttctggattaattggggagggggggggggggggggggggctgtacatccccagcagcaactcaatttacagaacttcatcccggcgggaatttaggagaaacattcacagcccctgaggcgatcccggggattttatacatcaaagtaggccaactgaaaaaaaagccccctaagacatatatccaaaacctgatggagatccaaaaagatttcccgccataggtccattagttaaaccgggtccgacaaaagcagccccagagaacccatatgcataaacccccattggagcacccattgtaggatgatcaaatttacagttggccccgaacttgcagatcccataacgagaatagaatttccaaagttcttcacctggacgtattggaagccccattggacttaagacacaatccggagggggctgtgatctcacacgggga

SEQ ID NO: 78148 - DNA, 568 bp, Zea mays
  Clone ID: LIB3079-024-D6-R1B
gcttcctcgcaccggctccggtcctcctcccatcaccatcaccaccgtcgttcctctcacgagtcccgacacacgcaaaccgcacgaaccctggctggcggcgggatgacgcggcggtgctcgcactgcagccacaacgggcacaactcgcggacgtgccccaaccgcggggtcaagatcttcggggtgcgcctcaccgatggctcggccatccgcaagagcgcaagcattggggaacctctccctcctctccgcggggtcaaccagcggcggcgcgtcgcccgccgacgggcccgacctcgccgacggcgagcgggggctacgcctccgacgacttcgtccaggggtcgtcctccgccagccgcgagcgtaagaaaggtgttccttggactgaagaagaacaccggaggtttttgctgggattacaaaagcttgggaaaggtgattggcgagggatttctcgtaatttcgtggtctcaagaacacctactcaagtagcaagtcatgctcaaaaatattttatacgtcaatcaaatatgagcagaaggaagagaaggtctagcctttt

SEQ ID NO: 78149 - DNA, 505 bp, Zea mays
  unsure at all n locations
  Clone ID: LIB3079-008-Q1-K1-H9-M1
gtcggaggcgaagatgtcgtcggtgttcagcggcgatgagacggcccccttcttcggcttcctcggcgccgccgccgccctcgtcttctcatgcatgggcgccgcgtacgggaccgcgaagagcggcgtcggcgtggcgtcaatgggtgtgatgcggacggagctcgtcatgaagtccatcgtgcccgtggtcatggctggtgtgctcggtatctactggctcatcatcgccgtcatcatcagcacggtgatcaaccccaaggccaagccctactacctgtttgatggctacgcccacctttcgtccgggcttgcctgtggtctcgctgggcttgcagctggcatggccatcggcattgtcggtgatgctggagtcagggcaaatgcgcaacagccaaagcttttcgttggcatgatcctcatcctcattttcgcagaagcgcttgctctctatggnctaattgttggaattatactttcgtctcgcgctggtcaatccccgggc

SEQ ID NO: 78150 - DNA, 602 bp, Zea mays
  Clone ID: LIB3079-008-Q1-K1-H9-N1
gggaaagaaatatttatatatcacgttcttatttggctacaattccgtgttctttattcagcaaggataaaattaaatccacttagcccaagagcatccgtccgactccgaccttaacccaaaaataaataacctctgctcgacaccaccaaaaccaaaacatgactggaagtcaccttccatcagctacagattgttacattaatacatgggaacaagaataaactagacaagggaatagagttccaatcctctcagaatagcataataaacggtgcggtaatcacagaatggcggtgcacttaatccgcccgggattgaccagcgcgagacgaacggataattccaacatttacaccatagagagcaagcgcttctgcgaaaatgaggatgaggatcatgccaacgaaaagctttggctgttgcgcatttgccctgactccagcatcaccgacaatgccgatggccatgccagctgcaagcccagggagaccacaggcaagcccggacgaaaggtgggcgtagccatcaaagaggcagtagggcttggccttggggttgatccccgcgctgatgatgacggcgatgatgagcccgaaaat

SEQ ID NO: 78151 - DNA, 517 bp, Zea mays
  Clone ID: LIB3079-020-Q1-K1-E3-M1
ccacaaccctctccctcttccatctcatttccgctgcggctgcaacaataaaataataagtctcgtgcaggcgaaggacgtacgacgacgcggacgcaccgtcaaagtctacaggctgcgcaatccctttctccctcttatccccaaggcgaggagctgagggggggggggggcccttctgctgctgttcttgtttccccgctctccaagatgtcgtccccgagcaagcgccgcgagatggaccttatgaagctgatgatgagcgactacaaggtcgagatggtgaacgatgggatgcaggaattcttcgtcgaattcaaggggccggccgaaagtatctaccaaggcggtgtctggaaggttagggtagaactgcctgatgcatatccttacaaatccccgtccatcggcttcatcaacaagatttatcacccaaatgtcgatgagatgtctggctctgtatgtttagatgtcataaaccaaacatggagcccaatgtttgatctagtaaatgttt

SEQ ID NO: 78152 - DNA, 570 bp, Zea mays
  unsure at all n locations
  Clone ID: LIB3079-054-Q1-K1-E2-M1
atttccttttgctcaacctgacgtacaagagcgagagccgtgctgacgcccatagaggtatcgtggctcgccagaaggacacggaggcgtgaacatggacagtgactggatcgcatcggtgcctgccaggcgcgacggacacttgggtcgacaaatgggatgcacagagcatgcttcacttcaagcaggagaaaggctgatcacaatttctttaaatctgtagttttgcgataactacagcaactgtgctagaactttttagatttgtattttagggataacataacaaacattaaatagttttgcaaatattcattaggttaggtctcccataatgctatagtgatgcacaaaactaatgggcaccacaccgaacatcggaacatcccagtgctggagttttcaaataaggtcctctttaaatctgtagtgtttaaataagggtttggtagagtttctcttaattctgattcaccaaactaccaaagcatgttcttgccctgctataagttttacaggcatgaattantgtcacataaaagcatgttcttgccctgctataagttttgc

SEQ ID NO: 78153 - DNA, 515 bp, Zea mays
  Clone ID: LIB3079-054-Q1-K1-E2-N1
caaggccggcaaaacttatagcagggcaaaaacatgcttttatgggacactaattcaggccggaaaaacttatagcagggcaaaaacatgcttggggggtggggggaaccaaaataaaaaaaaactttcccaaccccttatttaacccctacaaatttaagggggcccttttttgaaaaccccaccccggggaggttccgatgttgggggggggccccattagtttggggcttcactatagcattaggggagacccaccctaaggaatattggcaaaactattaaagggtggttagggtacccctaaaaaacaaatttaaaaggttctaccacagtgggtgtggttttcgcaaaactccggattaaaagaaatggggaccaccctttctcctgcttgaagggaggcatgatcggggcaaccaaaatgccaacccaagggtccggcccgccaggcaggccccaaggctggcagccctgtccataaacagccaccgcgtcttttttgccgacccaaa

SEQ ID NO: 78154 - DNA, 130 bp, Zea mays
  Clone ID: LIB3079-002-H7-F4A
ctgagcaatcttgtagaacgtgtagatgtcctcaatgtattccaccaccgcgagctcattgttgacgtccagcttgtcgatgtcatcgaccacttgtctaggcttaccagcgattccacaggcagccttt

SEQ ID NO: 78155 - DNA, 601 bp, Zea mays
  Clone ID: LIB3079-001-F5-F1B
actcataatgggtaccctttatttcggtatattatattatatacacaaaatcgacaccgtacagctcggaacaaatcacaagcgaactcaggtctttagaaaatgaaacacattgaagcattacaacacacttaaaacctggctactggatagctcagttgatgtttgaatgaccactcagtcctggatattttctttcgtcatttggcccaccaagaagcctttctcaagatggcctagaccggacagtggtgtctagtgatcttcttgtcgcctcttagtactctcttctccggcgcttgaaactggaaggtacggtgaagtgactttgggagttctggagggaggtaatttcaggaacaaacatggtgctgtcatacgcagggaaacacaaattcccatgccagttgagccccgaggctgttggtggagagggaacctcaggcactgtccatgaattctcaggtactcggcccatatattcatcggtgatcaatccaggcacctgccctaatagttcctcagcaactgagccttcagccaaacggcattgtggagatccaccagcgccccccagcttagcggtatcacccttagaaga

SEQ ID NO: 78156 - DNA, 207 bp, Zea mays
  Clone ID: LIB3079-001-F5-F2A
gttataatttcccacctaacaatatttggcgccgtacaacaacaaacgcaaccaacacttacatatctttattcccaacacgaaattaggattatacaatctcagatcccgaagcagagccgcgcaccttttaaaacaaaaccagcccacccaccaaaaaactgacgccgaggaggtttctccccacccaggtggggagcccaaaat

SEQ ID NO: 78157 - DNA, 551 bp, Zea mays
  Clone ID: LIB3079-001-F5-F2B
actcataatgggtaccctttatttcggtatattatattatatacacaaaatcgacaccgtacagctcggaacaaatcacaagcgaagctcaggtctttagaaaatgaaacacattgaagcattacaacacacttaaaacctggctactggatagctcagttgatgtttgaatgaccactcagtcctggatattttcttttggcatttgggcccaccaagaagcctttctcaagaagggcctaaaccggacagtggtgtctagtgatctttttggcggcctttaagtactcttttttcggcgcttggaacttgaagggaccgggaaaggactttgggagttctggagggaggtaatttcaggaacaaacatggtgctgtcattccccagggaacacaaatttccatgccaagtgaacccccaaggttgtggtggaaaagggaacttaaggcactgtccatgaattctcaggtactcggcccatatattcatcggtgatcaatccaggcacctgccctaatagttcctcagcaactgagccttcagccaaacg

SEQ ID NO: 78158 - DNA, 645 bp, Zea mays
  Clone ID: LIB3079-001-F5-F3A
cgggtgccgctcctgacggacgccgccgccgatgccgccgcagcggcgccggccgtgcccaagtgcgacatctgtcaggaggcttctggatacttcttctgcctagaggaccgtgcactactttgtagagactgtgatgttgctatacacacagtgaattcctttgtttcagtacatcagagattcctgctaactggagttcaggtgggtcttgatcctgctgatccagttccacctattgctgaaaagcatgttaatgctgttggtggatcagtgaatcaaccagtgagacattagccaaggagaagcccgacagttcaattttcaggtgaagggagtgcttctgttcctaccaaaaatgtaacaaatggagattgttcaaggcagaattttgtcccaacagccagagcagaagtggttgattggactatgaataatagtacaattcgatcagtagaatctccgcctaagtacatttcacaggaaagccccacacttttgcaatctagccagaccacaacagtcttctccaaccaaattaatggcaatagtgatggggcctaccacttgtcattctcaggtggtaatgtgacagacagcctaccagattggcccgtggatgagttcttgagtaactcagaatat

SEQ ID NO: 78159 - DNA, 210 bp, Zea mays
  Clone ID: LIB3079-001-F5-R2A
cgagccgtgccactgcgagggaaggagggagagaaaaaggggagcccgatccaatcccaatcccctcccgccgcgtcacatcgccgccgtcctcgtgccccgttacctctaaaaccctagcggggagccgccgagccggggatgaagatccagtgcaacgcgtgcggggccgcggaggcgcgggtgctgtgctgcgcggacgaggccgag

SEQ ID NO: 78160 - DNA, 560 bp, Zea mays
  Clone ID: LIB3079-001-Q1-K1-D4.F1
aacctggaaattaagcattccattatattatatctccatcatcattgcactgcatacacaaaacaagcaggattctgcaaaccctacagtaccaagcacagctactagtaccatttcccagcagcgcagaggaaatgcatgagcatcatgtaaccaaaaggggggagatatgagaataggaataggaaatcctgaagaacagcagcacgtacggtgtgttgatcggttcatctccatcgcgacaatgagatcgatcttaacactagataagcacccggattaatctattgtttaagccctacctcgctcggctatacgcctgcctagttgaacaccgacagcggcagatgcaccccgccgcgtgcgcttccgccgccgccgccatcgccagcgctatctcgtccccgctgccggcagcgacgctagcgctgctgctgctgccatcgccattaccattgccagccaccgcttcggggttgcctggcagcagtcggaacccgtgcaggaactgcgggtgtggcatgaagaagtggtgctgatgccctgcccggcgtcgggga

SEQ ID NO: 78161 - DNA, 131 bp, Zea mays
  Clone ID: LIB3079-001-Q1-K1-D4.R2
atcagtagtaaccactcatcgtcgtctatctggcggactcgcctcctgcagctagctctagccagaaaggcaaaccggatctgcttcagcctcccgtccagtctcagcgccgacgcctgatcgagcagagc

SEQ ID NO: 78162 - DNA, 533 bp, Zea mays
  Clone ID: LIB3079-002-H7-F2B
accttgtaaaacaccattcacatttatgaataaaaatgttgtactagatagaattatagttgccatcacaagtcagataacaaccgactctgagaacagcctagcaaacaaacggctgtctgaaacaagcaaacataaaaaagcctagcgaatgtcagactcgccttccatcgccacttcccctaaagcaagcaataggcaaacacggataaagtagccttcgttcacttgcagatctcctctgcgggtggacgcagcgcgacccctccgaactgctcgctggaatacttcttgtatacaaccctcagcttgctctcaggggcagtcgagtgcgcgatcaccagcatcttcgtgcattcaatgagctctgcctctgactccctgaagcccgtgtggtgcttgagggtgtcggtccaaaggggagccctcttgagagtgagtctggctgcgtagacagcagaagcagcgaccagcgatggcaggcgcgtcaccaaatcgtattgatcagcgccaattcagcgaagaaaacacca

SEQ ID NO: 78163 - DNA, 357 bp, Zea mays
  Clone ID: LIB3079-002-H7-F3A
aactttgccgccaatgttgcggccttcagaaaacggacaaggaacatatacactgtagggacagtcaggttccactccagcctattcagaattcccttctccatcgaaagaatctgttctctactgtatgcactgtctgatatgaggatgaagtcgttcacctctggggcccaaatctcctcgtacttgcaggcgatcagcatagatgaaacgccgacaagctgcagctccttacgcaggactggttgcagcgagaggtactgatcgatgatgtacatggtcaggtagagagtttcgggcatcagttcaaacttgtggcgtacttcgattatccaatcagccaggatagccctcatc

SEQ ID NO: 78164 - DNA, 665 bp, Zea mays
  unsure at all n locations
  Clone ID: LIB3079-002-H7-R3A
ctttcgatggagaagggaattctgaataggctggagtggaacctgactgtccctacagtgtatatgttccttgtccgttttctgaaggccgcaacattgggcggcaaagttgagaaagagatggagaatatggtgttcttcttcgctgaattggcgctgatgcaatacgatttggtgacgcgcctgccatcgctggtcgctgcttctgctgtctacgcagccagactcactctcaagagggctcccctttggaccgacaccctcaagcaccacacgggcttcagggagtcagaggcagagctcattgaatgcacgaagatgctggtgatcgcgcactcgactgcccctgagagcaagctgagggttgtatacaagaagtattccagcgagcagttcggaggggtcgcgctgcgtccacccgcagaggagatctgcaagtgaacgaaggctactttatccgtgtttgcctattgcttgctttaggggaagtggcgatggaaggcgagtctgacattcgctaggctnttttatgtttgcttgtttcagacagccgtttgtttgctaggctgttctcagagtcggttgttatctgacttgtgatggcaactataattctatctagtacaacatttttattcataaatgtgaatggtgttttacaaggt

SEQ ID NO: 78165 - DNA, 82 bp, Zea mays
  Clone ID: LIB3079-002-Q1-K1-A8
aaaaaaaaaaaaaaaaaaaaaaaaataaaaaaaaaaaaaaaaaaaaaaaaaaaaagggaaaaaaaaaaaaaaaaaaaaaaaa

SEQ ID NO: 78166 - DNA, 62 bp, Zea mays
  Clone ID: LIB3079-002-Q1-K1-B10
aaaaaaaaaaaaaaaaaaaaaaaaaaaaaaaaaaaaaaaaaaaaaaaaaagaaaaaggaaaa

SEQ ID NO: 78167 - DNA, 105 bp, Zea mays
  Clone ID: LIB3079-002-Q1-K1-D9.R1
gcggacgccagcgcgaggcattaacgctctgccgttaccgaaaactgcgtgaccccggcgaccgtcgcgtcagtcacaggactcctcagcacgtgatgctgctgg

SEQ ID NO: 78168 - DNA, 306 bp, Zea mays
  Clone ID: LIB3079-002-Q1-K1-G12.F1
gtcttgtcgcatgtctcttgatccctcacatagttaacatgtataactcggttgcaattgcaaactgttcgatatgtacaagtgtttctgtgtttgactctcagtactgcaccgcacgtccacaccaacattcacgtttgtatctatttctctccgataaagtgagatacaacaaattgccaaaaaaaaaaggaacttattccactgttatctgaagcacggtggtgagtctgggtttcctatacctcctcagcagcagcgacgacgacaccacgctgacggacgagaacgccatgcacgcgccgg

SEQ ID NO: 78169 - DNA, 595 bp, Zea mays
  unsure at all n locations
  Clone ID: LIB3079-002-Q1-K1-G12.F2
gtcttgtcgcatgtctcttgatccctcacatagttaacatgtataactcggttgcaattgcaaactgttcgatatgtacaagtgtttctgtgtttgactctcagtactgcaccgcacgtccacaccaacattcacgtttgtatctatttctctccgataaagtgagatacaacaaattgccaaaaaaaaaaggaacttattccactgttatctgaagcacggtggtgagtctgggtttcctatacctcctcagcagcagcgacgacgacaccacgctgacggacgagaacgccatgcacgcgccggctaaccaaggcggcatctggaccccggtgaagggaaacaacgcgccagcagctacggggatggcgatcacgttgtaggccatggcaaagaagtagttccaccggatccggatgaacgtcttccgtgagaggtcaatagccgtgatcacatcctccaggttgttccggacgagcacatagtcagccgcctcgatagcgatgtcagtgcctgcgccgatggccatgccgacatcggcggcagcaagggcgggcgagtcgttgatgccatctncgaccatcgcgacaacact

SEQ ID NO: 78170 - DNA, 601 bp, Zea mays
  unsure at all n locations
  Clone ID: LIB3079-002-Q1-K1-G12.R2
cggacgcgtgggttggggtacaagtcatgtcaatgagagtatggtaactggtgaatctgtaccaatctccaaggaagtatccagtctagtcattggaggcacaatgaacttgcatggtgttcttcatatacaagcgacgaaagtaggatctggaacagttttgagccagataatttctctcgtggaaaccgcccaaatgtctaaggcccctattcagaagtttgctgattatgtagccagcatttttgttcctattggcatcaccctgtccttcttgacattccttgcatggtttctatgtggatggntgggagcatatccaaactcatggtctgctgaaagtagcaattgctttgttttctccctaatgttctccatatctgttgtngtgattgcttgtccatgtgctcttggtctggcaacaccaactgctgttatggtagcaactggagtcggngctagtcatggagtacttgtaaagggcggagatgccctggagagagctcagaatgtgaagtatgntatttttgacangaccggaacactgacccaaggaaaggctactgtaactgcnacaaagattttttcaggaatggatctg

SEQ ID NO: 78171 - DNA, 279 bp, Zea mays
  Clone ID: LIB3079-002-Q1-K1-G3.F1
aacatggcatacattatcaggtgacgggtccacatagcacaacttcggttccactaacatcattacaggctccttggcagccaagagcagttccacccagtagacggaacgggtatatattgccgggaaaaaccaggcggcgaccaaagctgatggggttcctttcagaatccttgatttaaacagcagcctccacaagcattggacgacctccctttctcccttgccgcaattcagtcgaaagataaatcctcttgtaaaaaacagggtggcttttca

SEQ ID NO: 78172 - DNA, 311 bp, Zea mays
  Clone ID: LIB3079-002-Q1-K1-G3.F2
aaggggttaacatgggatacatttttagggggcgggtccacataacacaactttgggtccactaacataattacagggttttgggagccaaaagcagtttctcacaatagacgggacgggtttttttttcccggagaaaaacaggcggggaccaaagctgatgggggtccgtttcaatatcctttatttaaacaaaagcctccccaagcattggacgacccccctttttttcttgccggtttttaatcaaaaaactgaatgttctttttaaaaacaaggggggtttttaacaaaacgtcttttattttggg

SEQ ID NO: 78173 - DNA, 80 bp, Zea mays
  Clone ID: LIB3079-002-Q1-K1-G3.R1
tcgcatttcaagcatggccacgggagaccagggacacatgatgatcctgcagatcatagctacgacgcgtccgggtcctt

SEQ ID NO: 78174 - DNA, 573 bp, Zea mays
  unsure at all n locations
  Clone ID: LIB3079-002-Q1-K1-G3.R2
catgtcaagcatggccacggggcaaacagggacaccatgatgatcctgcagaacagcagctacgacgcgtgcgggtcgttcatggtctactcctctctcgacaagcagctggtggagacaattacgaacccgggtgacagccaggcgatgagcagcatcaacctcttccccgccggcttctccctcgtccccctcaccaacccggacccggcgccgcaagagggctccggcagcatcgcacagcctggggcgaccgtgatgactgccgggttccagattctgatgaagatggcccgtgggaccggcctttgccctcgctcggtgtcgtccgcggtcaagatcatgtcagacaacatcaccaacatcaaagacgctctgttgaaaagccaccctgttttctacaagagcattcagtctgtcgactgaatagcggcaagggagaaagggaggtcgtccaatgcttgtggaggctgctgtttaaatcaaggatactgaaacggaaccccatcagctntggtcgccgcctgcgtttctcccggcatatatacccgttccgtctactgtgtggaactg

SEQ ID NO: 78175 - DNA, 244 bp, Zea mays
  Clone ID: LIB3079-003-Q1-K1-B4
gtgagttggggcgagctgatacgcggactctgtttattatcttttgaggcaattcaaatgagggaggattttcatgggacccactgtagatttctaatgccactgcactgggctacctgaggcagcgcaccttgagcttagcgatattgcatatgtttgttaaaattggtatatcaagttgctggtgcaaaggttttttctgaaatatatattgatcttgtgttggattggtaaaaaataaaaa

SEQ ID NO: 78176 - DNA, 318 bp, Zea mays
  Clone ID: LIB3079-003-Q1-K1-B7
cccaggcgtacgtaaagttgaaatttcattactactggtatgaggactgattgcctgcggcataagatgaactgtaggtgaagtgggtcctgcaattggtcatcttcatgtctattcacattcctggtggacttccactcacatctacatgttgaaaaccattatgggactcttcatgtgtagactcgtgtagagactcttggacatccatattgacaacgatcattaaattaaccacttctggagcaaaaaaaaaaaaaaaataaaaaaaaaaaaaatgaaaaaaaaaaaaaaaaaaataaaaaagggctggccatt

SEQ ID NO: 78177 - DNA, 479 bp, Zea mays
  Clone ID: LIB3079-003-Q1-K1-D6.F1
ttctttttttttttttttttttttttttttttaagcagcaacacaagccacccggatcttacattatggaacttttcaaagttatagaatctacaaaatctggacatgatgcctatagacagcttagcaagagctaagcaagcgaaaacaaaactgagaaatataacagcaagactcctgttctccatgtcagtctgtttttgccgaaatatttcaaattccaatctgagtagagcattatccaggaccagctggtttagttgcgaggaagcaactaacttccatgagaggaatccatcaacttcattcataatgttatctttgctgctctcaagattcttcagctctgattggatcttctctaacaagacatctttgctatcaatatcggcatcgaaatccttaaagatttgcccatatctgctgttcaactccactaggtacctctccaaaacagagaagctcacatcaagagattg

SEQ ID NO: 78178 - DNA, 551 bp, Zea mays
  Clone ID: LIB3079-003-Q1-K1-D6.F2
aagcagcaacacaagccacccggatcttacattatggaacttttcaaagttatagaatctacaaaatctggacatgatgcctatagacagcttagcaagagctaagcaagcgaaaacaaaactgagaaatataacagcaagactcctgttctccatgtcagtctgtttttgccgaaatatttcaaattccaatctgagtagagcattatccaggaccagctggtttagttgcgaggaagcaactaacttccatgagaggaatccatcaacttcattcataatgttatctttgctgctctcaagattcttcagctctgattggatcttctctaacaagacatctttgctatcaatatcggcatcgaaatccttaaagatttgcccatatctgctgttcaactccactaggtacctctccaaaacagagaagctcacatcaagagattgaactttctgcattagcaccttaagaactgtatctccaggaatcctgccagcctgaagtgtccttgcctctgaaactggatcattagcaccattcttcaatgaat

SEQ ID NO: 78179 - DNA, 530 bp, Zea mays
  Clone ID: LIB3079-003-Q1-K1-D6.R1
atcacgggttgctcctcctgatctcgatgaattcaagacaagagcaattgctgaaaggggaccttggtatttctagtcaacctggtaatatcatccaccgaagggagcctaagtgggaagttgtataattatgctgcagcttctaaaggggccaaggttctggatttcaataaggaggctaagggtgcttccaacatctttagattaaggcaaagacaagtaccttcgcaatccttgctcagcagagggggaagtttgtcatcatagagctttctgaagaaaacttagttagatacaatcgcaatttgcaatttttgagcattatttcttctaaatccaaaagaatttgaactgctgagcatcctgacataatcccacagaaaacttgggaaatccttggaagattcactgccgcgaatgccaaacttgctcaaaatttcactttttccttgaccaaagtgggctaaattatttgaaactgaacttggtaagccattatggttctgagttctactgtactctcagtgtgc

SEQ ID NO: 78180 - DNA, 645 bp, Zea mays
  unsure at all n locations
  Clone ID: LIB3079-003-Q1-K1-D6.R2
atcacgggttgctcctcctgatctcgatgaattcaagacaagagcaattgctgaaaggggacctggtatttctagtcaacctggtaatatcatccaccgaagggagcctagtgggaagttgtataattatgctgcagcttctaaaggggccaaggttctggatttcaataaggaggctaagggtgcttccaacatcttagataaagacaaagacaagtacctccgcaatccttgctcagcagaggggaagtttgtcatcatagagctttctgaagaaaccttagtagatacaatcgcaattgcaaattttgagcattattcttctaatccaaaagaatttgaactgctgagcagtctgacatatcccacagaaaactgggaaactcttggaagattcactgccgcgaatgcaaaacttgctcaaaatttcacttttcttgaaccaaagtgggctagatatttgaaactgaacttggtaagccattatggttctgagttctactgtactctcagtgtgcttgaagtgtatggaatggatgctgtagaaaagatgcttgaanacttgattccagttgagaataagaaaacggaacctgatgacaagactaaggaacncattgagataatntatttgaaagatcctgc

SEQ ID NO: 78181 - DNA, 316 bp, Zea mays
  Clone ID: LIB3079-003-Q1-K1-E1.F1
gagtattatttttctagtgttgatccatgtagttctttaaattggatgatttattgggattacaatgggtctttttgttttttaaaaaccgaaagcccttattgaaacattggggcgctttaaaaaaaggagtggaaaagggtatccagggggcggtaattaaaaaaaggacccccccccaaaatccaaaggattcacattgggagggttaaactaaacaaaaggtggttttgggatccgggggtagggaaaaaatctggcaagggccaattgtcagaaacaagggaattttttttcccccgggaaaagtaacccc

SEQ ID NO: 78182 - DNA, 416 bp, Zea mays
  Clone ID: LIB3079-003-Q1-K1-E1.F2
ttttttttttttttgtttttttttttttttttttgttttttgttgtttttttttattgtttgtttatgattgggttctattggtctttttttgttttaaaaacaaaggccctaaaggaaccattagagctcatttaaaaacatgcggcaaaagggggccaaggggggggtatctaaacaaaaattccccccccaaaattaaatgagacccatttggggggaaaaaatataaaaaagggtaattctggctcccggggaatggaaacattttttgctttccccaatccgcgagggggtaggtattttttttccccccgaaaatgtattgccctgctgcaaaccccccaaaggaggaccttaagggtttgggaaaacaaaacaaggtgggaaccccattggggaagttgttaggggtat

SEQ ID NO: 78183 - DNA, 628 bp, Zea mays
  unsure at all n locations
  Clone ID: LIB3079-003-Q1-K1-E1.R2
gaaatataaaaccctttttaagggacgatggccgaaaccaaactggtgctttttaccgtttcctttgttgcaaacgctaaatttctcacgaattcttccgtcgtcggcggcgcagattgaatgccaaaaccctagctcgccctccccaattccccatttcggccacaccctccttgcctccacggctccacccctgcttcaggttacctgtgccagcgacgccggtagaagccatggacagctctctcgcgagcgcggcggcgatagccgatcagcgccagaagatcgagcagtaccgccacattctcgcctacgtcctctcgtcttccccaccggacatctctcaggccaagcgcttgctcgaccacatggtttcggacgaagttccgctcgtggtgtcgcgtcaattgctccagacgttcgcgcaggacctagggaagctggagtcggacgcgcanaaagaggttgcccactacgcgctcacgcagatccaggcgcgtgtggtctccttctaggagcaggtggtagtgattagagagaagcttgcagagctatatgagtctgaacaacaatggtcaaaagcagcacaaatgcttagtgggattgacttggattcaggaatcaggat

SEQ ID NO: 78184 - DNA, 553 bp, Zea mays
  Clone ID: LIB3079-003-Q1-K1-E8.F2
gagacagaattattctagtattgtccccagttgttccttaaaattggagggacaagagaggataccaggggacattcctgttttggctatccagcaaccaaacgcacccttaaatctcagatccatgcaagcaacatgatagcacaattatgtctcgcgctcatgaaaaagaaccagcaaaattttcactatgattcagatcgtcaaaattgggctggcgtgcagaaagtgttacagaacaagaataaccacatgaactggtttcagggatttgttagcttccagctacttcccgttagcgctcttgtggaaaggccagaggctagccaacctttcaagcacccctgcccctttggagaagtagcccaaggcttgtggcggagcggcaggagggaagtcctccggcggcatggcgaatggccgcaccattttctcgaacttgtccatggtcaggcaggacccaacttcctgcagtctctcgggccccattatgggcaaggtgtgctcctggagcaaggaagaactttcactggttttgtcctctaggggactg

SEQ ID NO: 78185 - DNA, 457 bp, Zea mays
  Clone ID: LIB3079-003-Q1-K1-E8.R2
cacattttcaaaatatgaccaggcaaaagctcttggaaagacaactattgatgtggctcgtattgctgccgggttgccatgtggtagtgaaagcttcctcttgatgtttgccagatggagaaaacttgagagggatttatacaatgaaagaaaggaccgttttgacattacacagatcccagatgtatatgattcctgcaagtatgaccttttgcataatgctcatctcaatcttaagggtttggaagagctattcaaagttgctcaaatactcgctgatggtgttattccaaatgagtatgggatcaacccaaagcaaaaactgaaaatcggctcaaagatagcgcgccctttattgggaaaaatcctaatcgatctacgcaacacttgtgaaaaagctatcagtgttgccgaaccaaatttattgaagacgaagctctattcccaccaacaaaag

SEQ ID NO: 78186 - DNA, 172 bp, Zea mays
  Clone ID: LIB3079-003-Q1-K1-H2
tctgtatctatatatgtaataatgcagtatgacgacacacattatcatgtgtggtatgaccagtaatatatgcatggtcataataaagttttggttctaatgaatcaaagcaaaaaaaaaaaaacaaaactagataaaaaacaaaaaaaaaaaaaaaaaccaaaactaaaaa

SEQ ID NO: 78187 - DNA, 217 bp, Zea mays
  Clone ID: LIB3079-003-Q1-K1-H7
ggcttggcggaatcagcagggtaaagttgtttggcctgattaaattgcataggttggtgatgatgcctgtatgccggcattggacagctagcgtggtagtatgtttcttctttgtttttctttctgctttttcttttttgtcttgccaggtcattgttttgttggatcaatgacctggcaagacataaaaaagatcaggcttgacctccttaacaaa

SEQ ID NO: 78188 - DNA, 74 bp, Zea mays
  Clone ID: LIB3079-004-Q1-K1-C10
aaaaaaaaaaaaaataaaaaaaaaaattttaaaaaaaaaaaaaaaaaaaaaatggaaaggaaaaaataaaaaat

SEQ ID NO: 78189 - DNA, 70 bp, Zea mays
  Clone ID: LIB3079-004-Q1-K1-H1
acgaggaaaaaaaaaaaaaaaaaaaaaaattttaattaaaaaaaaaaaacaaataaaaagagggagggtt

SEQ ID NO: 78190 - DNA, 349 bp, Zea mays
  Clone ID: LIB3079-005-Q1-K1-B12
cacggggttcgccatcaccggcttcatcatcaccaagatgacggccaacttcaccgaggaggaccgtcaagaactccaagttcgtccaggaacacaagaagcgctgaccaaccgggtggagtcgtccgaatcgcctgcggatgaaaaattagccccctatttttcttgtcttttttttatctagatgcgtgcactctattgtaataatgtaataagaggcaattggattgatccaacagcaaccggcttctgattttgatccgcttcgctgacatatgcatgcagcaaacgaatatgtgccttttttttttcttgatgttggattgcatctaatcctgttgaattggtg

SEQ ID NO: 78191 - DNA, 419 bp, Zea mays
  Clone ID: LIB3079-005-Q1-K1-C3
gccagagccagacgccgtcggccgtcctccaccgccctccaggtacgccgccggccccctcctgcctcctccctccaccggcacccccaaagccgccaccgccgccagctactgcctctcccgtaccgccgccgccatcgtacgagcaggccgtaggggtgggtggtggccgaagggaggaggatgacgacgagggcgccggggcggtgatacgggcacacctgctctctgacttcaaggccgcggtgcgtgcaggaaaagtactggtgtccgacccgtcgtctggaaagttgaagggcaagctttgaaaatgtcatccactgtgccgaagtcatcaaatatcttctggcatgattgcctagttggcaagactgatcgccagaagctactcaaccagaaaggctgtgttgtctggatca

SEQ ID NO: 78192 - DNA, 587 bp, Zea mays
  Clone ID: LIB3079-005-Q1-K1-F4.F2
gctactatattttactcttgtttttattaacattatacggtacaacgcacacgacaagcggaaaataattgtggtctttccttatcacagcaagttcatgaggcaagcaattgacgttaacaaataactaatcgattgaattgcgaccacaccacgaccgatgtctaaaccatcacttcccaacccactattggcccccacagctcggtaatgcatacatgacatgaataatttaggatggaatcttctgattattggcctcaacaatttcttgaatgaccctgtgcagggcaaaatcatccgtgacgatcgtagaatgctgggccttattgatcttgatggatttgaactgcttcttctgctccggctgccgacgcatctccttctcaaacgccaagacgctgatcaaattgatcttgccatctccgtccccgtacgccgccacctccggggccgcgtcgaagtcttcgccccagaacaccagccgcagcggcgtcctgttgccgaccccgctgatgtacgtcatgggcaccatcggcgccgcgaagctgcccatcttggggacggcccgtcttctgaagggctcc

SEQ ID NO: 78193 - DNA, 610 bp, Zea mays
  Clone ID: LIB3079-005-Q1-K1-F4.R2
cttcggctccacaagagccttcagccacaagaaccccctcaagtcagactggtgcctcggaaagctgagagccgcactggaagacatgggataccgagacggagacaccatgttcggagccccctacgacttccgctacgcgccgccgtcccccggccagacgtccgaggtgtactcccgctacttcaaggagctgatggagctggtcgaggccgcgagcgagaggacccggaagaaggccgtcatcctcggccacagcttcggcggcatggtcgcgctcgagttcgtccggaacactccgccggcgtggcggcgcgagcacatcgagcgcctcgtcctggtcgcgccgacgctccccggcgggttcctggagccggtgcgcaacttcgcgtccgggacggacatcctctacgtgccagcgacgacgccgctggccacgcgagccatgtggaggagcttcgagagcgccatcgtgaacttcccgtcgccggccgtgttcgggcgcctgcaggcgccgctcgtggtcaccagggagcggaactactccgcgtccgcgcacgacatggagcgcttcctcgccgccgtcggctccggcgaggccgcggagccc

SEQ ID NO: 78194 - DNA, 260 bp, Zea mays
  Clone ID: LIB3079-005-Q1-K1-G11
acgcgatgcttttcacgacgaagagcttgctttcagggacagccctaccggaaggcaccaggttcaggggccactgctttcctgatccgcataggttcgcgctacgggcatacgcagactccatccccttcagatacagccagcttgacgcgatcctaaggataaaaccgatccctctagggtccaagaaggcggagcaagtctctgacacactacgggcatgcgaggccgagttctcggacgcttatgcctgcgccatc

SEQ ID NO: 78195 - DNA, 95 bp, Zea mays
  Clone ID: LIB3079-005-Q1-K1-H10.F1
gtcaacagatagaatattatattccatttcgtataacggtttcatatatcatctgcagatcaaaaagtgaaggacgaagaacttcgacgacagag

SEQ ID NO: 78196 - DNA, 623 bp, Zea mays
  Clone ID: LIB3079-005-Q1-K1-H10.F2
gtcaacaagatagaatattatattccatttcgtataacgttttcatatatcatctgcagatcaagaagtgaagaccgaagaacttcgacgacagagcagagaaagggctagcacttgattaacatggtacatcgactgattaagcaagctacacgcttagcatcggagttggaaaagttcccgagtcctgacgagaagcaacgcattacgtacgcatactcgcgagagcaagaactagagaaatcacggagcaaatggtagacatgctactactagctagcgctagcttgcacaggatgccatcacatcatgcatgcatggcggcgcgtatagaagtgttggctggtggtggtgttcatcagtcgtagagcggcgggcactggaagcccgacggcgcgtgcttgccgcaggtgatgagcaggttgagcgcgatggggaggtagatgttgatgttgagcaggcgcgcgcggatggtggtgcagaggcacagcgccgcgtccaggtccgccaccccctgcaccagcgggcagcacttggacctggcctcctgcccgatcaaccaggtggatcagcccgctcagcacgtccacgcacgcgttcagcttcagcgtgtcgatcgggca

SEQ ID NO: 78197 - DNA, 223 bp, Zea mays
  Clone ID: LIB3079-005-Q1-K1-H10.R1
gtcgcgcgccgctgcgtttgagccaaggcgcaatggcaacctccacctcagttcacgtcctcctgctcctcgcagccgccgccggcctcctcctgctccccggctcgctggcgtggcagagcagcaactgtgcacctggcgcgccggcagtggctccccgtcgaggccttcacccggctccggctccggcggcggccacagcaagccgcccgagcaccaccat

SEQ ID NO: 78198 - DNA, 599 bp, Zea mays
  unsure at all n locations
  Clone ID: LIB3079-005-Q1-K1-H10.R2
gtcgcgcgccgctgcgttgagccaaggcgcaatggcaacctccacctcagttcccgtcctcctgctcctcgccgccgccgccggcctcctcctgctccccggctcgctggcgtggcagagcagcaactgtgcaccgggcgcgcccggcagtggctcgccgacgtggccttcacccggctccggctccggcggcggccacagcaagccgcccaagcaccaccatggcaagccgcccaagtgcccgccgtgcaaccctccgtacgtgcctccgacgcctcggccgtcaccgccgtacgtgccaccgtatgtcccgccgacgcctcggccgtcaccgccctacgtgccaccatacgtncccgtcccgccgacgcctcggccctcaccgccgtacgtgccaccatacgtncccgtccccccgacgcctcggccctcaccgccctacgtgccaccatacgtccccgtcccgccgacgcctcggccgtcaccgccgtacgtacccccgacgccacgggcgncgactccgccctacgttccaccgacgccgccctacgtnccaccgacgcctnggccatcaccaccaccgtacgtgccaccctacg

SEQ ID NO: 78199 - DNA, 368 bp, Zea mays
  Clone ID: LIB3079-005-Q1-K1-H11.R1
ctcttgtctctttttttctttttttttttttattttttttcttttttttttgtttatttttttttttttttcttttctttttttttcttttttttttttttttttatttttcttttttttttttttttgttttttttttcattttttttttcttttttttttctatttttttttttttttttattttttttgtttttttcttttttctttttattttttttttttttttgttttttttatttattttttttttttttttatttttatttttttttttatgtttttttttttttttttttttttttctttatttattttgtctttttttttttttttttttttttttttttctttttttttgttttttt

SEQ ID NO: 78200 - DNA, 73 bp, Zea mays
  Clone ID: LIB3079-005-Q1-K1-H2
aaaaaaaaaaaaaaaaaaaaaaaaaaaaattaaataaaaaaaaaaaaaaaaaaaaaaagagaaaaggataaaa

SEQ ID NO: 78201 - DNA, 437 bp, Zea mays
  Clone ID: LIB3079-005-Q1-K1-H8.F1
cataacaaaccgagtatttcgacatagcaaagccattatttcaataccagtacttgaaaacaaagtattggtcatggtttacataacaaaagaacaacatagttctaatttccacttaacctccagcatagtcctaattcccggtcctcataatctaaggaaaggtctcactaacgaaccgagcaagaaaacttatctgatatgtcaatgggagagtagggaactgccttgctaatccaggatttttcactagatatgcaaagtaaaaggccttgtggtgtgtcatcaaaacctggaatactttgcaatgtttgaagcaatccgggggtaggcatctgaactagccttctcaatagccattgcaagcctttcagcaccatctttgaatgctccaatcaggcctgccttcttcattacgagtaacctttgccttcttc

SEQ ID NO: 78202 - DNA, 573 bp, Zea mays
  Clone ID: LIB3079-005-Q1-K1-H8.F2
cataacaaaccgagtatttcgacatagcaaagccattatttcaataccagtacttgaaaacaaagtattggtcatggtttacataacaaaagaacaacatagttctaatttccacttaacctccagcatagtcctaattcccggtcctcataatctaaggaaaggtctcactaacgaaccgagcaagaaaacttatctgatatgtcaatgggagagtagggaactgccttgctaatccaggatttttcactagatatgcaaagtaaaaggccttgtgtgtgtcatcaaaacctggaatactttgcaatgtttgaagcaagtcaggtggtaggtcatctgaactagccttctcaatagccattgcaagcctttcagcaccatctttgaatgctccaatcagccctgcctcttcattactagtaacctttgccttcttcctaggtctaggagctgaggatgaagccccaatatcatctataggactaggaacagcattaacatctccctcatcaatctatgtttcatactagaaaatggaaagaatgggtgtggcatcatcaagtattttaaatc

SEQ ID NO: 78203 - DNA, 201 bp, Zea mays
  Clone ID: LIB3079-005-Q1-K1-H8.R1
cccacgcgtccgcaaaaatatggatgagtgatacaactgtgtgaacatgcttagacttggtaggtctagtttcgttcgcttttgtaagggctttagagactgaggtttacttgaagatacaatacacatgtgtgttgaggaacaagtggccatgtgtttgaacacaatgggacagaaccttaggaataggttggtcggaac

SEQ ID NO: 78204 - DNA, 514 bp, Zea mays
  Clone ID: LIB3079-005-Q1-K1-H8.R2
cccacgcgtccgctaaaatatggatgagtgatacaacatgtgtgaacatgcttagacttggtaggtctagtttctttcgcttttgtaagggctttagagactgaggtttacttgaagatacaatacacatgtgtgttgaggaacaagtggccatgtttttgaacacagtgggacagaaccttaggaataggttggtgggaacaaattatggtagatctggtgagactgttagtcgctacttcaacaaagtgcttcgtgctattggagagctacgagctgaacttattaggccaccatcattagagactccatccaaaatagcaggaaatccaagatgggatccctactttaaggtgtgatattcagctattcaatattctccttcaagaattttcactatttaaacccataagacccttaattgtattttggcttgtattggataaacataggattgcattggagctattgatggcacacatataagagcttcggtttccatagatatggaacc

SEQ ID NO: 78205 - DNA, 465 bp, Zea mays
  Clone ID: LIB3079-006-B9-R1A
cttccacaagcacctgctatagttgtgtggtgcaaagaccaggatgttgcctgccaaagtgtcatttggtttcctgatagtgtactgcgcagtaacgttttcggcgtaggtcagatagctgtgtggcgaagcatgcacagtggatcacagggacaagatcacaacggactgcagatagttcatcaagctgaaatgccccgtcacataggcgtcgtacaccgacgactgctgcgtcgccataagagcggtgcccaatctcgacatggagtgcatcattcgcctgctctccaataaacagaagaaggagtacgacgtggacaagatccggcggctcggcagcgtcctctgcaatccacatccggtgatgacgtaaaatggggtgtggcagtagtttctgatggagtgcatcgcgtcaacaatatggagcttgaactatacaaaccctactgataatgtgtcaccatt

SEQ ID NO: 78206 - DNA, 352 bp, Zea mays
  Clone ID: LIB3079-006-Q1-K1-A7
aagaaaaaaaaaaactaaaaaaccttttttaaacaaaaaaaaaaaaaaaaaaaaaggagaaaatatcaaaaaatcaaaaaggacaaaaaaaaacaaaaaggtcgtcccttctatacatcccatacttacttccccctccatccaacttcttagcttttctataagcactcctaaattcacttcactgcccatcttcttacaactaatagacttgcaaaacctttcctttacccaacttaactgcctttcacaaaatcccccttctaccacatgtcttaatacccaaaacgcccgaaccgatcacccttcccaacaattccccacccataatggccaatggtacaaccccttt

SEQ ID NO: 78207 - DNA, 603 bp, Zea mays
  Clone ID: LIB3079-006-Q1-K1-B1.F2
gaatagggccgttccaggccaaccgaacgaggcctaaacatatgtcaaacacagttagacttgtagcttacattgctgtcgcatctcccagcaacaacagattacaaccctcgcggactgggaaaacatagcacagggacatagaaaggcggcgcccaggcggttaaaatggtgcggacggcgccttctttcaggaacctacgacgcgaggaagagcaggacagtcaggagtggtgggtgctgggtggtatctggtatcggcagagcacaggtgccatcttcgttcaccagggagttttgtcgcctggcccagcaaggatgatatagcgcttggtgaaggcgcatacgttgcaatctacagcgaaacgccgagcgagcatgatggctgcgttgcgttctcgagtgctctcgaaggctagcaccaagctgaggtcgtttctgggtcgccaaaacatcgcctgcgaggctgcttcgcctccgcctctcacaccacataactgcatcgatgaggaatagaattccttggcgactaccgacttccctttagtaagcctcatccgcagcctcccgacatttagtacatgaaccgactcttttggctga

SEQ ID NO: 78208 - DNA, 173 bp, Zea mays
  Clone ID: LIB3079-006-Q1-K1-B1.R2
gcgcatggatctgtcaaatatttcaatgcggtggggtcgtatacatccaaaagaaagcaacaaagagattatttcaggtgccacaagaccagtatatgctctagagccacatgacgtaggacgctatttgcaagctgaaatcgaggtaggcggcgaaatcgcaggagcaaaga

SEQ ID NO: 78209 - DNA, 223 bp, Zea mays
  Clone ID: LIB3079-006-Q1-K1-B6
gcgaccaggacctccatgccgccgccttcgccaacgtcgccgccgacgaggtctacggcgtcatggagcccgacaagtgcctcgccaagacggccagattgttggcctattgattgatccatcactcctagctactcctactctggtcgctgcctattgattgatccatcaatcctgttaattttcagaagagtttcagaagagtcttaataaaaaaaaaata

SEQ ID NO: 78210 - DNA, 431 bp, Zea mays
  unsure at all n locations
  Clone ID: LIB3079-006-Q1-K1-F12
gatatttaatgtttcagcttggttggtttttaacttggcccttaataaaatttttggttgtttaataatcttaatccataaactaagttggtatgtagtgacgggtaagaaatactgtggtggtttggacctcagttattggccagatgaagggcgaaggccattatcagatcctcgtccacctttgggctattgctgacaagtggacgagtgtcgtacacctctccaattccccccttcaatgtggtcagtgttgaatcatctacgtcatacagtgagcaagggcatactgatgagggaagggatgacatggatttttctcgttcgagcatcaggttttgtgcgttgattatggtgtgctcgttggtgagactgcgacgtnctcgttcaagtcagctgataatcgtgtccttcaagagcaactactacag

SEQ ID NO: 78211 - DNA, 489 bp, Zea mays
  Clone ID: LIB3079-007-E5-F1A
ccaggaagtagcatcatggtacatcattgattatcaatatcacgagattccagtagctatttcagttgatctaagaaaagaagacggttaaaagctcaaacagcaagaaatgacgtcaactgaacctaacagctggagcatttccaaaccgcagttcaagtatacagtaatcagtgtcaaaacaggctgggaaaaaacagcctaaactcaccagctgccaaccccctatcccattcccaaacatcatgaggaaacacaaatcacatttatgatgtggaacaagcttcgagctttgggaggacgctgcgccatgcatccgcaatgtctttagctagcttagcctgacccttggcaaattcatggaatgcgagtccaatatcagctgtcttttgctcctggaaacgagcaagctcttcattcattagtctaactatgtgttcaaacttcttagtagcctcctcactgtctgctttcaactctcgaaactca

SEQ ID NO: 78212 - DNA, 472 bp, Zea mays
  Clone ID: LIB3079-007-E5-R1A
cccacgcgtccggaatgttgtcaataaagctgcacagacttgtagacaaccttcacgttaactttgaagaatccttgagagcttatgtgcctgctgtagaatctatacaagctagtatgcttgctcgagcgaatgctttcaggcagcacttcgatttggatcaggagaggctgtatcttgagctttatcttgacatattgccggtcaagtacgctgaagagtattccgaagcatcgatctgagtttcgagagttggaagcagacactgaggaggctactcacatgtttggacacatagttagactactggatcaagagcttgctcgtttccaggcgcaaaagtcactcgatatcggtctcgcattccatggatttgccaagggacctgctaagctagctgaagactttccggattcattgcccacgttcctcccaaagctcgaagcatgaaccacatcatgaaatgtcactt

SEQ ID NO: 78213 - DNA, 427 bp, Zea mays
  Clone ID: LIB3079-007-Q1-K1-C2
ctggtacgaccgagctcgctcgcttgtcttgacgatgagtgctgactgaccaaccagctgctatacaacctgggtggtctgagccagcaacacacgctgtcacgcaagggcgccaacgaggtgctactcgtcatcaaggcctacaagactctgcgcgaccgtgcgccctacccggtcagcttcatgctcgcccagctcaccggctgctacaccttcatcctcttcgacaagtccaccaactccctgctagtcgcatacgaccccgagggcacggtgccgctcttctgggggatcaccgccgacggctgcgtcgccttctgcgacgacatcgacatgctcaaaggctcatgcggcaagtcgatcgcgccgttcccgcaaggctgcttctactccaacgccctctggaggctcaagtgctacgagaacc

SEQ ID NO: 78214 - DNA, 401 bp, Zea mays
  Clone ID: LIB3079-007-Q1-K1-D2-F2A
agccgccaataaccggtttgatgtatagcatatagaaattgtttcctacgataaaaaccggcagtctgtaattaaattatgtatcgtgtatgctttcaatatctccctatactggatcacaacaacccggttcaaaacttcaatgcagcaatctgtcaactttggaggtacaatggtggaacagatgaaacattgttgcttgatgcttcgcctaatctcaattccaatcaatggcgttcttcagcaaactggatctgttcaagtggtgtaaactgggcagtgctcctgttcctagaaaatcggtagcccacaaagatggacatgcaaatggctaccactgaaagaagtaaagcaaagccagttgcagcatcccaagagcgattaggagctggacggtaata

SEQ ID NO: 78215 - DNA, 404 bp, Zea mays
  Clone ID: LIB3079-007-Q1-K1-D2-R2A
gctgttcacgggtttgaagcgaaaattcgcccaaaccaggccggcgacggacgcctcctcgttctccacgccgccgccgccgccgccgccgcgttggctaggttgacctgaccgatcttgacttctctaggctcttgcatccccgacgacggaaatagcctccgagtttccaacagggtggctccggtcgaccacgaagcctcgatctgcatgacgaggctactcgtcatcctgttcgccggggcgaccctagtagtcgccaccaccgcgcacgagcaccatggtgaggcgcccacctgcgccggaggcagcgagcacgtgcttgcggagttccgccccggtgaggtgaccgtggacgggcacaacgaggactgggagagcgtggaggcctcggagttcgcgct

SEQ ID NO: 78216 - DNA, 300 bp, Zea mays
  Clone ID: LIB3079-008-Q1-K1-A2
ggagaacgtggagaaggctagagcggccttcctcgccaggtgcaaggccaactccgaggcgacccgcggcacctacaagggtgatgctgccgccgacaccgagagccttcacgtcaaggactacaagtactgagttgcttctctttgcgatcccgttgttttggaactcctgcctgcgagtaggttgctgagtgttgtttgcttgttagagcttttatattcggacatgaaaaaaacatgcttcctatgtggatgatggttatctttatattcgtatattaactactagtctctgttgtt

SEQ ID NO: 78217 - DNA, 90 bp, Zea mays
  Clone ID: LIB3079-008-Q1-K1-B10
aaaaaaaaaaaaaaaaaaaaaaaattaaaaataaaaaaaaaaaaaaaaaaaaaaaggaaaggtataaaataaaaaaaaaaaaaaaaaaat

SEQ ID NO: 78218 - DNA, 53 bp, Zea mays
  Clone ID: LIB3079-009-Q1-K1-A2
atttgttttgtgcttccaaaagataaggtccttggactagactagctcctttt

SEQ ID NO: 78219 - DNA, 71 bp, Zea mays
  Clone ID: LIB3079-010-Q1-K1-A1
gaattccggtcgaccagctccgacacgcgtacgattttcgccactcaggttcagaaaaaaaaagggcagaa

SEQ ID NO: 78220 - DNA, 506 bp, Zea mays
  Clone ID: LIB3079-010-Q1-K1-C9.F1
aacccgagcacagaaacccaccctttgggatccacgaccatacatcaaaaactgctggattattggaacatttcataatacaaggacaacaccttggagattagaagtacacaacttataatttcaatgcaaaactggacaggaaatagggtagtttggtgacacattttccagacagaagaggatggaaccacaatcagtttggaggggaaagagtttcttattggaggcccaagtagaccttcggggcaaagatcggaagggtgttcaggaagacggcggcgagcagagtggcgggcgatgaggtcatcgtaggggtcccgacggccggcggcatggctgatctggggatccaggagagctgcgagttgaagcggtcgaaggtccagaagccgtaggggcgcagagggaggctccacgccgccttagtgcgctcgcaccgctccttcatcttgtagacatgctcccgccgaacctggtcgcgcttgtccgggtctccatcagac

SEQ ID NO: 78221 - DNA, 627 bp, Zea mays
  Clone ID: LIB3079-010-Q1-K1-C9.F2
aaaccgagcacagaaccacctttggatccacgaccatacatcaaaaactgctgattattggaaacatttcataatacaaagacaacaacttgagaatagaagtacacaacttatacttccatgccaaactggaacaggaaatagggtagtttggtgacaacattttccagacagaagaggatggaaccacaatcagtttgaggggaaagagtttcttattgatgcccaagtagaccttctgggcaaagatcggaacgggtgttcaggaagacggcggcgagccagagtggcgggcgatgaggtcatcgtaggggtcccgacggccggcggcctggctgatctggggatcccaggagagctgcgagttgaagcggtcgaaggtccagaagccgtaggggcgcagagggaggctccacgccgccttagtgcgctcgcaccgctccttcatcttgtagacatgctcccgccgaacctggtcgcgcttgtccgggtcctccatcagacggaggatcatattctccgcgaagtccatgatgaaacccatcgccgccttcggtcgccctcttccccctctccggtgagcttgggatctgccggcgcgtcggtctctctctgtcccggcgagtc

SEQ ID NO: 78222 - DNA, 378 bp, Zea mays
  unsure at all n locations
  Clone ID: LIB3079-010-Q1-K1-C9.R1
gcttggacagggtgacaacagtgtgaagcccgctaaagagantggttgcaaaaatctctactccgacccccatctaaggcaccgactcgccggggacagagagagaccgacgcgccggcagatcccaagctcaccggagagggggaagagggcgaccgaaggcggcgatgggtttcatcatggacttcgcggagaatatgatccaccgtctgatggaggacccggacaaacgcgaccaggttcggcgggacatcgtctacaagatgnaggagcggtgcgagcgcactaaggctgcatgaagcctcctctgcgcccatacggcttctggaccttcgaccgcttcatctcgcagctctcctgggatcccagatcagccag

SEQ ID NO: 78223 - DNA, 599 bp, Zea mays
  Clone ID: LIB3079-010-Q1-K1-C9.R2
gcttggacagggtgacaacagtgtgaagcccgctaaagagagtggttgcaaaaatctctactccgacccccacctaaggcaccgactcgccggggacagagagagaccgacgcgccggcagatcccaagctcaccggagagggggaagagggcgaccgaaggcggcgatgggtttcatcatggacttcgcggagaatatgatcctccgtctgatggaggacccggacaagcgcgaccaggttcggcgggagcatgtctacaagatgaaggagcggtgcgagcgcactaaggcggcgtggagcctccctctgcgcccctacggcttctggaccttcgaccgcttcaactcgcagctctcctgggatccccagatcagccaggccgccggccgtcgggacccctacgatgacctcatcgcccgccactctggctcgccgccgtcttcctgaacacccgttccgatctttgcccagaaggtctacttgggcatcaataagaaactctttcccctcaaactgattgtggttccatcctcttctgtctggaaaatgttgtcaccaaactaccctatttcctgttccagtttggcatggaagtat

SEQ ID NO: 78224 - DNA, 130 bp, Zea mays
  Clone ID: LIB3079-010-Q1-K1-D2
gtgttcttatgctaaatgtgtttctaatgtttggcacattttaaattgcttgttgtttaggaatggttaaaacccttgaaggtctggtatctgcttggagatgttaaaaaaaaatgacttgtgctaacta

SEQ ID NO: 78225 - DNA, 146 bp, Zea mays
  Clone ID: LIB3079-010-Q1-K1-E5.F1
acagctagcgcgacgcgggcgtcacggcatggtcagcgtcatcgcgcacgagctaggccgagctcgccacgaacccgctcgtcaacgcgtggtacgccggtggaggaccccacggcgcccaccgatatcgccgacttgtgcaaggg

SEQ ID NO: 78226 - DNA, 652 bp, Zea mays
  Clone ID: LIB3079-010-Q1-K1-E5.F2
aacggcgacgcgggcgtcgacggcatggtcagcgtcatcgcgcacgagctggccgagctcgccacgaacccgctcgtcaacgcgtggtacgccggggaggaccccacggcgcccaccgagatcgccgacctgtgcgagggggtgtacggtacgggcggcggcggcgggtacgccgggaaggtgtcggtggacgcgcaggggaggagctggaatgtgaatgggaggaaggggaggaaattcttggtgcagtggctgtggagcccagaggctaaggcgtgcgtggggcccaatgccagtgactaggcttattggccactgctagcatgtaactaccatgtagtagtagtttattattctcagctttactttatattatattatatataaaaaactattatatgataaaaaaaaaaaaaaagggcggccgcctttttttttttttttttttcggtgttcaagcatcagttcacatggtataacaacttaaactactataagcattacatggtcagatatgtatagcctaactcggataatctcaatataaaaatgagggttcccttctaattggccttactccttacaaacaacatcagaaacaactaacccttcctggtacattagtttgaatactgggacaataacttttttt

SEQ ID NO: 78227 - DNA, 420 bp, Zea mays
  Clone ID: LIB3079-010-Q1-K1-E5.R1
cccacgcgtccgcccacgcgtccggaacttctaaagcagagtctgatggtatgaagaaggggatgaaaataccgaaagtagaacctgatgttatggactggaaaactcccaaagcaggatctgatgttacgaagaagggcttgagatctccaaaggcagaatgttgccagcctgtgattgagagcgttacactaaagctggcagagattttcaatactatatcaactcaagatgactgcaaaatgttgcaacaccaactttgatacccagaggaaacgagctagatctacgaagatgattcgccggcatatggacttccgaatgcttcactctaagatcaagagtggcgcaatctctggcaccaaggagcttttggagagatatacttattttcatcaataatgcaataaccttctatcc

SEQ ID NO: 78228 - DNA, 665 bp, Zea mays
  Clone ID: LIB3079-010-Q1-K1-E5.R2
cccacgcgtccgcccacgcgtccggaacttctaaagcagagtctgatggtatgaagaaggggatgaaaataccgaaagtagaacctgatgttatggactggaaaactcccaaagcaggatctgatgttacgaagaagggcttgagatctccaaaggcagaatgttgccagcctgtgattgagagcgttaaactaaagctggcagagattttgaatactatatcaactcaagatgactgcaaaatgttgcaacaccaacttgatacccagaggaaaagagctagatataagaagatgattcgccggcatatggacttccgaatgcttcactctaagatcaagagtggcgcaatctctggcaccaaggagcttttgagagatatacttattttcatcaataatgtaataaccttctatccgaagactacattagagcacatggctgcggttgagcttcgtgactttgcatgcaaaactgtgaagcagagtgcaagcttgttcttgaaaagccatcgagagaccagaacagctggtgcccctgtaataaagaagaatgctcgagccctgcatttttcaagaacaagcttgcactctggggatgcaagggcaagcaaggtttcttcaagggatgctgctgccaaagaaggggatggcaagagaccttgc

SEQ ID NO: 78229 - DNA, 262 bp, Zea mays
  unsure at all n locations
  Clone ID: LIB3079-011-Q1-K1-A4.F2
gaaccacctttggatccacgaccatacatcaaaaactgctgattattggaaacatttcataatacaaagacaacaccttgagaatagaagtacacaacttatactcccatgccaaactggaacagggggggggggagcntggtgacaacattttccagacaaaagaggatggaaccacaatcagtttcaggggaaagagtttcttatcgatgcccaagtagaccttgtgggcaaagatcggaacgggtgttcaggaagacgg

SEQ ID NO: 78230 - DNA, 119 bp, Zea mays
  Clone ID: LIB3079-012-Q1-K1-F10
aaaaaaaaaaaaaaaaaaaaaaataaaaaataaaaaaaaaaaaaaaaaaaaaaagagaaaagaaaaaaaaaaaaaaaaaaaaaaaaaaaaaaaaaaaaaaaaaaaaaaaaaaaaaaaaa

SEQ ID NO: 78231 - DNA, 96 bp, Zea mays
  Clone ID: LIB3079-012-Q1-K1-G6
aaccaatcccgaaatgaacttttcatttaaaagggagaaaaagggccctattccgctgcttgattcagactaccaatttctgaaaattattttgca

SEQ ID NO: 78232 - DNA, 67 bp, Zea mays
  Clone ID: LIB3079-012-Q1-K1-H4
aaaaaaaaaaaaaaaaaaaaaaaaaataaaaaaaaaaaaaaaaaaaaaaaaaaaaaggaaaggaaaa

SEQ ID NO: 78233 - DNA, 382 bp, Zea mays
  Clone ID: LIB3079-013-Q1-K1-A9.R2
ctacgaacgggggccgggaaaagaccggctacagacagatgaggctctgtctccggcaagcggcggccaccagctcacccctcgcagctaccctccgcggcaagacttctacgagcaccctcgccccccatggccggctcagcttcagccacaccacgtcgctgcatacggcgcccgggcaccgcgggctccgagcagggtgggcggtgcgcgtgctcccgctgacggatgagaacgtggagaaggtgctggacgaggtgcggccgaacctgatggcggacggcggcaacctggcgctgcacgagatcgacggccttgacgtcgtgctcaagctgcagggcgcgtgcggctcctgccccagctccaccatgacgctcaagat

SEQ ID NO: 78234 - DNA, 131 bp, Zea mays
  Clone ID: LIB3079-013-Q1-K1-C12.F2
aggcccaagaaaaaaaaccaaaaaccccaccagagccaaacaaagaaccgccacacgcaaagaccaaaccagaaaaaaccaggccacgccgcacaccacacacggagcaacgggggggcaaaagaaccgag

SEQ ID NO: 78235 - DNA, 70 bp, Zea mays
  Clone ID: LIB3079-013-Q1-K1-H12
aagaaaaaaaaaaaaaaaaaaaaaaattaaaaattaaaaaaaaaaaaaaaaaaaaaaagaaaaagtaaaa

SEQ ID NO: 78236 - DNA, 597 bp, Zea mays
  Clone ID: LIB3079-013-Q1-K1-H2.F1
ggtcctacaactgagacctctggtaagattgacgccaaatacagttgtgcttacacatagtcaaacgatccatatagtaggtgaatcaatgaggtggcaaagacgcattgaaaaaaataaaataaagcagtgctagtactagtaggccgaagcaaagagctgtacacatcctgtggtgggtttccagcttcagctgcagcctgcagctgctgtacacttgtttaccaacgaaatctcacttgatgcatgcctgcctcgccgcctaatcggatcgcccaacaacagtcacctagagcgggcttggcttattaccaggcgctggtctccctgtccctccgcggcgggatctgcgacggcgacacggcgactcctcgctggcgctgctccgcgagtccccgcgccagtcgtcctgcacctgcgccgcgaactgcaggttccacagcacgtcctccaccgacggccgctgctccgcctccttggccaggcagcgcaggcagatctccatcaccgtccgcgccgactcgtcggagcacgcccggctcaccgcctggtccaccagcgccctccgccgccccgggctctccgacgtcagcgccg

SEQ ID NO: 78237 - DNA, 569 bp, Zea mays
  Clone ID: LIB3079-013-Q1-K1-H2.F2
taccttttttttttttttttttttttttttggtcctacaactgagacctctggtaagattgacgccaaatacagttgtgcttacacatagtcaaacgatccatatagtaggtgaatcaatgaggtggcaaagacgcattgaaaaaaataaaataaagcagtgctagtactagtaggccgaagcaaagagctgtacacatcctgtggtgggtttccagcttcagctgcagcctgcagctgctgtacacttgtttaccaacgaaatctcacttgatgcatgcctgcctcgccgcctaatcggatcgcccaacaacagtcacctagagcgggcttggcttattaccaggcgctggtctccctgtccctccgcggcgggatctgcgacggcgacagcggcgactcctcgctggcgctgctccgcgagtccccgcgccagtcgtcctgcacctgcgccgcgaactgcaggttccacagcacgtcctccaccgacggccgctgctccgccttcttggccaggcagcgcaggcagatctccatcaccgtccgcgccgactcgtcggagcacgcccg

SEQ ID NO: 78238 - DNA, 415 bp, Zea mays
  Clone ID: LIB3079-013-Q1-K1-H2.R1
cccacgcgtccggcacgcagccgcgccacatttcttctacattctcaatctcaacggtgcggctctcgttctttctttctttcttcctttctgtttgctgcatcgatgtagggaggaggaggaggaggaggaagcaagtatccatctgacagcagggtgcccccaatggcgacaagatcgacatctacgatttcggcgtgatcctgctcgaggtcgtgaccgggaggcccatcacgtccatacacgaggtggaggtcatgaaggagcagctgcagtcggcgctgacgtcggagagcccggggcggcggagggcgctggtggaccaggcggtgagcggggcgtgctccgacgagtcggcgcggacggtgatggagattgcctgcgctgcctggccaaggaggcggacagcggccgt

SEQ ID NO: 78239 - DNA, 630 bp, Zea mays
  Clone ID: LIB3079-013-Q1-K1-H2.R2
cccacgcgtccggcacgcagccggcgccagccatttcttctacattctcaatctcaacggtgcggctctcgttctttctttctttcttcctttctgtttgctgcatcgatgtagggaggaggaggaggaggaggaagcaagtatccatctgacagcagggtgccccccaatggcgacaagatcgacatctacgatttcggcgtgatcctgctcgaggtcgtgaccgggaggcccatcacgtccatacacgaggtggaggtcatgaaggagcagctgcagtcggcgctgacgtcggagagcccggggcggcggagggcgctggtggaccaggcggtgagccgggcgtgctccgacgagtcggcgcggacggtgatggagatctgcctgcgctgcctggccaaggaggcggagcagcggccgtcggtggaggacgtgctgtggaacctgcagttcgcggcgcatgtgcaggacgactggcgcggggactcgcggagcagcgccagcgaggagtcgccgctgtcgccgtcgcagatcccgccgcggagggacagggagaccagcgcctggtaataagccaagcccgctctaggtgactgttgttgggcgatccgattaggcggcgaggcaggc

SEQ ID NO: 78240 - DNA, 175 bp, Zea mays
  Clone ID: LIB3079-014-Q1-K1-C10.F1
aaagggctttttttttgttctgtttttggtcctacaactgagacgtctggtaagattgacgccgggtaaagaggtgcttagacatagctaaacgttccatatgggaggtgaatcatcgaggtggcaatgacgcattgagtaaattaatttgaagcagtgcgaggtactagtaggc

SEQ ID NO: 78241 - DNA, 413 bp, Zea mays
  Clone ID: LIB3079-014-Q1-K1-F9.F1
tcgcctttttttttgttttgttcttttggtcttacagcctacacctcaggcatctggtaagattgtcgcgttgtactttcgagcatacacatagtcaaacgatccagatagtaggtgatcagtaaggtggcttagacgcattgaaaaaaatagaataaagcagtagctagtactagtaggccgcagcaaagagcttgtacacatgcctgctggtgtggtttccagcttcagtgcagcctgcagctgctggtacacttgtttaccaacgatatctcacttgatgcatgcctgcctcgccgcctaatcggatcgcccaacaacagtcacctataatagggcttggcttattaccagtcgctggtctccctgtccctccgcggcgggatctgctacggcgacaggtgcaactcctc

SEQ ID NO: 78242 - DNA, 443 bp, Zea mays
  Clone ID: LIB3079-015-Q1-K1-C2.F2
gcctggtttggtttttttgaaacgcacacttggatatagagacggaaccctaatgcacctaaataagcctatgatgaaacgggcctacatggggaaacaaccatagtgacaagcggaactatacatcttactacagtatgtaccaccacgaggcgggcacagaagctctggtatgctacgcgacaccaaaacatccagcagagggtagggcagttatagggaggcagctttacagcacaactgaacctctgattgttagggagctcattcatctgtagctggagtagatcctactgtaactagggtagatctgtgtgtagctggggtagcaaatattgctatactggattccttgagaagctcaatatcgttatagaggccgtgcattctggtccacagtgaattgacagaaagcgccactcttaaaactttgatagccattt

SEQ ID NO: 78243 - DNA, 77 bp, Zea mays
  Clone ID: LIB3079-015-Q1-K1-D12
aaaaaaaaaaaaaaaaaaaaaaaaaaatttaaaaaaaaaaaaaaaaaaaaaaaaaaaaagaaaaaaaggaaaaataa

SEQ ID NO: 78244 - DNA, 134 bp, Zea mays
  Clone ID: LIB3079-015-Q1-K1-E9
cgaattcccggctgcatgcacgcgtaccgccactcattcggttctagttcgcgagttgctgccctttttttttttttgttttttttgttttttttttttttttttttttttttttttttttttttttttttttt

SEQ ID NO: 78245 - DNA, 80 bp, Zea mays
  Clone ID: LIB3079-015-Q1-K1-F1
aaaaaaaaagaaataaaatagataaagtttaagtttataaaccaaaaataaaaaaataagggaagggttaaattaaaggg

SEQ ID NO: 78246 - DNA, 630 bp, Zea mays
  unsure at all n locations
  Clone ID: LIB3079-015-Q1-K1-H1.F1
catcacagtttctaccttgggcatcctttattcaccgctcgggttttcaatgtctaatgtttccaggctataagcatgtgaatcattacagctgaccttggccagacttctaaatggcaacatattctatggtttatatatggtacaatacaaactggcaacgagcacgggatatgacacacataaattgtacactacataggccccaagacttcctgcctgtcctaagctcaatggaagatccttccagaaattttgaacatgtcactgtgaactaaacggaagctcattctgtgctcgggacgcttgcggtctcagctacatcgctgctggctttcacggcgccacganaactgcagatcttgttcagggcgctcaggtaagctctgacactggacaccacaatgtccatggatgccccgctcccgctgaaggagcggttgaaggactggccagtcagggcatgtttggcgttgttgctcacatctccagtgacaacaacccgagttgtcgcgattgcgtcaatgccttctgtgactgatgtcatactgtattctcggagaaccgttggaatctggattattttgtcaacagctttgtaagctgcatcgactggacctgttcgactga

SEQ ID NO: 78247 - DNA, 562 bp, Zea mays
  unsure at all n locations
  Clone ID: LIB3079-015-Q1-K1-H1.R1
ccaaaatccaaatcaccacatccccccnnattaatttaaggggtttttaatgtccaccgccgccgccagcgccaactaaacccgcgacgacggtcgaccattggcgtcctcgctgctctcctcccccgctaaacccaccatcaccaccaccaccaaaacggacccggccccaaggaccgcccgctccgcccatgtccatgtcctctcccgcgcccgctgcctccgcctccgcctccgcgcgtcgtcgcagcatcctcccgcctccgcccaccccgcggtcgcggcggccggattaacgtccgaaccgcatcgacgaccccaactacgtgcgcatcttcgacaccacgctgcgcgacggggagcagtcgccgggcgccaccatgacgagcgcccagaagctcgtcgtcgcgcgccacttggcccgcctcggcgtcgacatcatcgaggccgggttcccggctacctcccccgacgacctcgacgccgtggctccatcgccatcgaggtcggcaacccggcgccaggacccgccggggaggaggacgccgtccacgtgccggtc

SEQ ID NO: 78248 - DNA, 591 bp, Zea mays
  unsure at all n locations
  Clone ID: LIB3079-015-Q1-K1-H1.R2
ccaaaatccaaatcaccacatccccccattaatttaaggggtttttatgtccaccgccgccgccagcgccaactaaacccgcgacgacggtcgaccatggcgtcctcgctgctctcctcccccgctaaacccaccatcaccaccaccaccaaaacgaccccggccccaagacccgcccgctccgcccatgtccatgtcctctccgccgcccgctgcctccgcctccgcctccgcgcgtcgtcgcagcatcctccgcctccgcccaccccgcggtcgcggcggccggattacgtcccgaaccgcatcgacgaccccaactacgtgcgcatcttcgacaccacgctgcgcgacggggagcagtcgccgggcgccaccatgacgagcgcccagaagctcgtcgtcgcgcgccagctggcccgcctcggcgtcgacatcatcgaggccgggttcccggcctcctcccccgacgacctcgacgccgtgcgctccatcngctcggaggtcggcaacccggcgccaggacccgccggggaggaggacgccgtncacgtgccggtcatctgcggcctctcgcggtgcaaccggaggaca

SEQ ID NO: 78249 - DNA, 102 bp, Zea mays
  Clone ID: LIB3079-016-Q1-K1-A11
ggacccccccttttgccgatcattaagccccgcggatggggaggttacccgcaacgtgaccggtacactttccaatggcctaaggtccggttcttttgcttt

SEQ ID NO: 78250 - DNA, 235 bp, Zea mays
  Clone ID: LIB3079-016-Q1-K1-A9
gtaaaaatgtgggatacaacagagtgtaggatagaaatctacttaaaaggggacgggggagcaccttagatggtcggaacgggaaacattctctggcagtttgacaaattgtagttctgcaccctctttttttttggtagtttataagaaacactttaatttatcatcatgtacttttaacaacacttggggtatggtaagtgcatttggtgctgaaaaaaaaaaaaaataaaaa

SEQ ID NO: 78251 - DNA, 593 bp, Zea mays
  unsure at all n locations
  Clone ID: LIB3079-016-Q1-K1-D7.F1
gacgctggatcaagatcaattattgtaattattttgcagctggtgtaacatttgccatgacaagatgaaaaaaaaacaaaattgtnttttgattaaatgaaacaggatcacagctctcaaaacttgagtgtctacatctgagtctgtgtccatgtatatggtagcagcaggctaaacttatttctgtcaggaacagagggggggaaacgccgcttcacagtctcattccatcagcttccatcgaccaaagaaggtaggaccctaactcaatttggtttggtaacctcatgaattgcatttgctaggtaaccaacatttcctgtcgtaacaccagccatgcttatcctcccattgcgggtcatgtaaatgtggtattcatttgttaaacggtcaacttgttcaggtgtcatcccactgtagcagaacattccaatctgattagtgatatgatcccatgacaaaggtgaactagcttttcaagattttccttaagtgccttcgcattccaatgatacgatcagccatacccttgacttcttttaaccacaaactcttcaattctggatcactgaggattatagaaacaccagtgc

SEQ ID NO: 78252 - DNA, 625 bp, Zea mays
  unsure at all n locations
  Clone ID: LIB3079-016-Q1-K1-D7.F2
gacgctggatcaagatcaattattgtaattattttgcagctggtgtaacatttgccatgacaagatgaaaaaaaaacaaaattgtttttgattaaatgaaacaggatcacagctctcaaaacttgagtgtctacatctgagtctgtgtccatgtatatggtagcagcaggctaaacttatttctgtcaggaacagagggggggaaacgccgcttcacagtctcattccatcagcttccatcgaccaaagaaggtaggaccctaactcaatttggtttggtaacctcatgaattgcatttgctaggtaaccaacatttcctgtcgtaacaccagccatgcttatcctcccattgcgggtcatgtaaatgtggtattcatttgttaaacggtcaacttgttcaggtgtcatcccactgtagcagaacattccaatctgattagtgatatgatcccatgacaaaggtgaacctagcttttcaagattttccttaagtgccttccgcattccaatgatacgatcagccatacccttgacttcttttaaccacaaactcttcaattctggatcactgaggattatagaaacaaccagtgcaccatgaacagngtgggttgctgtacattg

SEQ ID NO: 78253 - DNA, 520 bp, Zea mays
  Clone ID: LIB3079-016-Q1-K1-D7.R1
cagaaaaaccagcggcgcagtgacaaaagcccacagcttcttctccctactcctccagtcctccgtcatccgtttcgctctctgccgccgccaccgcacaagaagctagctcctgcctgtaccgccccgtcatggcgatgctatcccgcgcagctcctccgcggcccggcgcccgctgctgccgccgcctaggttctggcggtgagggcgatggcgtcgtcgctcttcggccacgtcgagccggcgcccaaggaccccatcctcggcgtcaccgaggctttcctcgccgacccctcgtccgacaaagtgaacgtcggcgtcggcgcctaccgggacgacaacggccagcccgtcgtgctcagctgcgtgcgcgaggccgagcgccggatcgcgggcaacctcaacatggagtaccttccgatgggaggcagcgtcaagatgattgaagagtcactgaagcttgcgtacggagaagattctgacttcatcaaagataagaggatagcagcggtgcaggcgc

SEQ ID NO: 78254 - DNA, 557 bp, Zea mays
  unsure at all n locations
  Clone ID: LIB3079-016-Q1-K1-D7.R2
cagaaaaaccagcggcgcagtgacaaaagcccacagcttcttctccctactcctccagtcctccgtcatccgtttcgctctctgccgccgccaccgcacaagaagctagctcctgcctgtaccggcccgtcatggcgatgctattcccggcaggcttcttcgcgggccggcgcccggtggtgccgccgcctaggcttctggcggtgagggcgatggcgtcgtcgctctttggccacgttgagccggcgcccaaagaccccattctcggggttaccgaaggttttctcgccgaccccttgttcgacaaagtgaaactcggcgtcggggcctaccgggacgacaacgggcaggccgtngtgctcaactgcgtgcgccaggccgcacgcccgatcgcgggcaacctcaacatggagtaccttcccatgggaggcagcgtcaagatgattgaagagtgactgaagctggcgtacggagaaaattctgacttcatcaaaaataaaaggatagcagcggtgcaggcgctttcatgcactggtgcgtgccggctctttgctgat

SEQ ID NO: 78255 - DNA, 59 bp, Zea mays
  Clone ID: LIB3079-016-Q1-K1-E1
aaaaaaaaaaaaaaaaaaaaaaaaaaaaaaaaaaaaaaaaaaaaaaaaaaaaaaaaaag

SEQ ID NO: 78256 - DNA, 241 bp, Zea mays
  Clone ID: LIB3079-016-Q1-K1-F2
ggcgccgacgcgctcagctacgcggccttcgctcagccggcgcactcgtctctggcttcggcgacggcaacaacctgaactctctcgccatctcacgagtctcgagagcggttcctccgcagtcgaaatggagcgtgacagtggcctctgctcgtctctgtctgtagtagcataccaataatactactcgcgaactctctttctgagcaaacagattccataaaaaaaaaaaaaaaacaaa

SEQ ID NO: 78257 - DNA, 263 bp, Zea mays
  Clone ID: LIB3079-016-Q1-K1-G6.F1
aaagttctccaatgagaagtcctgcatatattcgagttgttaaatcttacaaattttcggaagtgtgaatggtagccttggtgtccagtctacatatttatcggttattacaagacttcgttccccatcattgaattgttcagtgtcatgcacataataaaacaacaaatggtgaacgggccagcttaaaatgaaatcacaacgcagtgcatttagaaggatccttattctcgtacttgccatcaaactcttagaggtaaaat

SEQ ID NO: 78258 - DNA, 632 bp, Zea mays
  unsure at all n locations
  Clone ID: LIB3079-016-Q1-K1-G6.F2
aaagttctccaatgagaagtcctgcatatattcgagttgttaaatcttacaaattttcggaagtgtgaatggtagccttggtgtccagtctacatatttatcggttattacaagacttcgttccccatcattgaattgttcagtgtcatgcacataataaaacaacaaatggtgaacgggccagcttaaatgaaatcacaacgcagtgaattagaagatccttttctcgtacttgccatcaaactctagagataaaatcatcacaacttcgactgaacatttccaaagagaaatccttgggcaatttatgtagggagttcagatgatcaacatgaaggcgaacattgaaagaagcaggaatccacaacttcctgtcaacatcactgtaagtcttcgaaactatatcaaaaagagtttgggccccattctctatagagtgcagaatggacgcttctctagcccttcgattcctgaggtatccacaaagcatatacttgggccatagattaatccttccatgcattggaataatacatgtggtgacaactccaagaatttgtatgtagtttcaaagtaatncttcatgttgccaccatttctactgtccaaggttgcacttccatgccctacac

SEQ ID NO: 78259 - DNA, 326 bp, Zea mays
  Clone ID: LIB3079-016-Q1-K1-G6.R1
ggacagtatgcatatattggacttctgaattcggagctgtcatcaaactgcacagcttctcctgcattgcccttccaggaatacccacctggaataacacttgtacctatgaagagtaggacactagcgccattccgtacaactaatcttgtggtagtaagatcaaccaatggtgctggtggatctacatgttctgattattttgcttcgggggaagtctgcttatagatcccggatgcagctctcaggttcatgcagagcttgcagatctcattgattcccgtccaaaaaggttattagtgcttgtgacacattatcatcaggat

SEQ ID NO: 78260 - DNA, 654 bp, Zea mays
  Clone ID: LIB3079-016-Q1-K1-G6.R2
ggacagtatgcatatattggacttctgaattcggagctgtcatcaaactgcacagcttctcctgcattgcccttccaggaatacccacctggaataacacttgtacctatgaagagtaggacactagcgccattccgtacaactaatcttgtggtagtaagatcaaccaatggtgctggtggatctacatgttctgatttttttgcttcgggggaagctctgcttatagatcccggatgcagctctcaggttcatgcagagcttgcagatctcattgattcccttccaaaaaggttattagttcttgttacacattatcatcaggatcacattgagggtctttcagtcgttcagagatgcaatcctaatgctgttcttctgacacaccaaagtacaatggatcgcattgggaaaggaacttggcagattgactacacttcattaactggtggtgaaaagatatgcataggtgaccaagaactacaagttgtttttgcacctggtcatacagatggtcatatggggcttctccatgtaaataccaatacattggttgttggagatcattgtgtagggcatggaagtgcaaccttggacagtagaaatggtggcaacatggaggattactttgaaactacatacaaattcttggag

SEQ ID NO: 78261 - DNA, 286 bp, Zea mays
  Clone ID: LIB3079-016-Q1-K1-H6.F1
gaaaatggaatgcaacagaatatttttgtccatgaaaaggagcaatttattcaagcagagaagcaacagtatgccctcagatttgggaccttacttcaattcgaaatattctcaaaaactagcagggtgggggtggggggggggggggggggagggaaacacaaaaatttcaggggggggaaatatcgccatccatcgggggttaggtaagcccgaaaaaggatgggtaacctttgacccaggggaacctccgaaaattgggggaggaatattttctgtttggggg

SEQ ID NO: 78262 - DNA, 148 bp, Zea mays
  Clone ID: LIB3079-016-Q1-K1-H6.F2
gcatatgcaatgcaacagaatatttttgttccatgaacaaggagcacatttattccagcagagaagcaacagtatgccctcagatttgggaccttacttcaattcgaaatattctctataactagcagggtgggggtgggggggaggg

SEQ ID NO: 78263 - DNA, 111 bp, Zea mays
  Clone ID: LIB3079-016-Q1-K1-H6.R1
atcctaaaccctcctagtcctctccatccccatcccctccaatggcggcgactgccacgtccttcgccactctcgccgtcgcgcgctcggcagggcagcggttcctccttg

SEQ ID NO: 78264 - DNA, 522 bp, Zea mays
  unsure at all n locations
  Clone ID: LIB3079-016-Q1-K1-H6.R2
atcctaaaccctcctagtcctctccatccccatcccctccaatggcggcgactgccacgtccttcgccactctcgccgtcgcgcgctcggcagggcagcggttcctccttgcctccaaggccgccccctcgccgctcctctccctccgcggcgcccgcctcccttcgcagggcgtctccttatctgggggcctcgcggcgtcgccctctcatagccgcgcgcgcttcgccacatcagccagcgccgaacccaaggaagcagaacttcagtctaaaatcacaaacaaggtgtactttgacataagcattgggaaccctgtgggcaagaatgttgggaggatcgtcatcggcttgtacggggatgatgttccacagacaacagagaacttncgtgctctttgcactggagagaaagggtttggatacaagggatccagtttccatcgtgtcatcagcgactntatgattcagggtggagattntgacaagggcaatggtaccggtgggaagagcatatatggac

SEQ ID NO: 78265 - DNA, 587 bp, Zea mays
  unsure at all n locations
  Clone ID: LIB3079-017-Q1-K1-B11.F2
tctacgagtacgccaacaacagtgtgaagtccaccattgagaggtacaagaaggccaacagtgactcctccaactctggcacagttgcagaagtcaatgcccagtactaccagcaggagtcctccaagctgcgacagatgatccacagcttgcaaaacgcaaacactaggaacatagtgggagattccatccacaccatgggcctcagggatcttaaacaaatggagggcaagctggagaaagccataatcaagattagagctagaaagaatgagctgctatacgctgaagttgactatatgcaaaaaagggagatggatctgcagactgacaacatgtacctgaggagcaagatcgctgagagtaatgaaacggggcagccggcgatgcacatgacgatgggagcgccgccgacgagcgagtacgaccacatggcccctttcgactcgagaaactntctgcaagtgagcatgcctcagcactactcccatcagctgcaacctacaaccctccagctcggatgatgaaatcagcgctatacctggcggcgcccggcccccaatcgagatagatcacgcatgcagtta

SEQ ID NO: 78266 - DNA, 591 bp, Zea mays
  Clone ID: LIB3079-017-Q1-K1-B11.R2
atttacgcatacttatatatatatgatttgtgtgctttatataaacccgcgtttctgatgatatggcctggccggagggtacaatagtagtagatgcaacagctaaattcacacgtacaaatgcacgcacacagtggtggcactcacaaatatatataccctaacagttgcactaatcacaattattaataattaagcaaacgtacgtagagttacttgagatctcgatttggcacatgatataactgcatgcgtgatctatctcgattgggggccgggcgccgccaggtatagcgctgatttcatcatccgagctggagggttgtaggttgcagctgatgggagtagtgctgaggcatgctcacttgcagaaagtttctcgagtcgaaaggggccatgtggtcgtactcgctcgtcggcggcgctcccatcgtcatgtgcatcgccggctgccccgtttcattactctcagcgatcttgctcctcaggtacatgttgtcagtctgcagatccatctcccttttttgcatatagtcaacttcagcgtatagcagctcattctttctagctctaatcttgattatggctttc

SEQ ID NO: 78267 - DNA, 99 bp, Zea mays
  Clone ID: LIB3079-017-Q1-K1-C10
ttatagatcgcgagcggctgaccgtcaatggaaatcacatagaataacaaacaggggggtgtattaatgagaagatacaaaaaaacaacttcatataaa

SEQ ID NO: 78268 - DNA, 608 bp, Zea mays
  unsure at all n locations
  Clone ID: LIB3079-017-Q1-K1-C8.F2
aaattaaattctcggagctagtaagtccacctttacaatttcaagaatttgacattgtagcagtgaagacatccttcaacctctgctttcaagaatcacatgatagcatgatggtcggcatataagcaatttcaacattttaatcactgtggtaaaagtaaaactaacaatggacattggtgatgacgtgtgtacatccattcaaaagcggagtcacctgaaacaaagggtcctgtcaggttactttggttttctgcaatctggttttgataatatgggagacatgaaattgacgctatgagcctcctgaaggttgaactgctgcacgccaccaaaagctaaccgagaaactggtggagagagatctgacgtagtgccaccattttggagggatgtaaagcaggtcgccctcctccaatatgcagtcaatgaattccaggttntcaacccttggaaactccttcaaatcaatgttgtcaagatctacctgactggtattgcttagcatagtctctgtgtgtggatacaagtcctcagctatgaaagcaggatagagtctaatatacttcctgcccaatacctgagctaagatattgtgatgtggatca

SEQ ID NO: 78269 - DNA, 587 bp, Zea mays
  unsure at all n locations
  Clone ID: LIB3079-017-Q1-K1-C8.R2
cgacaggttccgagacatcgctgatgcactgaaaattcttccagcgaactctttatcctgtaagaaagttgagaggcgatcatgcatttccttggaggagttcatatgtaattactttttgcgcgacacccccgtcataattagtggcaccatcgaccattggcctgcaaggacaaaatggaaggacattgagtacctcaagaagattgctggagatcgtactgttcctgttgaagttggaaagaattacgtgtgtagtgagtggaagcaggagcttatcacattttctcagttcctggatagaatgtcgtcaactgtctgtccatcaaacttgacatatctggctcagcatccattgtttgagcagataaaagagctcagtgaagacataattgttcccgaatactgttacgctggtggaggtgcactccaatcacttaatgcttggtttggtccagaggggacagtgacaccattgcaccatgatccacatcacaatatcttagctcaggtattgngcaggaagtatattagactctatcctgctttcatagctgaggacttgtatccacacacagagactatgc

SEQ ID NO: 78270 - DNA, 63 bp, Zea mays
  Clone ID: LIB3079-017-Q1-K1-E5
aaaaaaaaaaaaaaaatacaaaaaaaaaaaaaaaaaaaaaaacaaaaaaaaaaagaaaggata

SEQ ID NO: 78271 - DNA, 619 bp, Zea mays
  Clone ID: LIB3079-017-Q1-K1-E8.F2
aacaaaacagagaacttcaatcaatgagaccgatgctgccggggtgcagttctacctgggttggccttgtaacaaccccagacgaggaacttcattcttttaacctactgggacctcaataatgcgtatgatttacctccaaaattaaagaaaaaccaatctctgagccaccaccttcagctatccatctttgttgaataccataattgacagggggaaaagaacttggaattcagtagataagaatatagtaccctcacaccttccaggctcgttgcacgcctatgttgctagactaccaatctgctgatcaagctgcatctgttcaagcagtgcccctaaaaccgcggcttggtcacgcccatccagctgggtgttcaggccagaaccttcgccgccgttgttcatgctgggaggcattagtggtgagggtccaacggaattaattgattcggacgtagtaacttgcttctctggcggagattccttgaccagtgtatgcacccaggagagatcagggtcatcgccgccagacctgagctcgaacgacgatgagcggcggagcttacccaattcttcaccatctacgccccaatctggtacccctgaaggagatccc

SEQ ID NO: 78272 - DNA, 599 bp, Zea mays
  unsure at all n locations
  Clone ID: LIB3079-017-Q1-K1-E8.R2
cacaggattttactctccaaaggcgtgtggacagcaagcagttaccttcacacccatctctgctgcatgcatcgcttgggatgccctcccctggccggatgtctccacgatgtgtcgaatcaggctccccgatgaactcccacctagctgctgctcttgcccagcgtgagaagcaacagcggacgatgagaagcctcagttctcgtgaccttgggcccagtgcggcacgagcttcagctctcggctcccctctaagcacatcatggtctaagtggggatctccttcaggggtaccagattggggcgtagatggtgaagaattgggtaagctccgccgctcatcggcgntcgagctcaggtctggcggcgatgaccctgatctctcctgggtgcatacactggtcaaggaatctccgccagagaagcaagttactacgtccgaatcaatcaatctccgttggaccctcaccactaatgccccccaacatgaacaacggcggcgaatgttctggcctgaacaacccagctggatgggcgttacccaaccgtggttttaggggcactgcttgaacagatgcagcttgatcagcaaattggta

SEQ ID NO: 78273 - DNA, 293 bp, Zea mays
  Clone ID: LIB3079-017-Q1-K1-F9
gctgctctctactctattcggcgactgatgacgaaccagagcgagcctggtattatcactggaaggtgcagagttgatgtgggcgtgatgtatctttctaagttattgtaagccggtctctgtcttcacaactgacgatctgtgtgtggtacgcaccacgcacgcaagtcgcggttgtgcgtgtacgtctgaactctggagcattggtttgttgtaccaacataatgagtcacaacggcggatggctggctatacgtaaaaaaaaaaaaaaaaacgtacaataaattttaaaa

SEQ ID NO: 78274 - DNA, 451 bp, Zea mays
  Clone ID: LIB3079-018-Q1-K1-F10.F2
gaaacacaaacaaaattgacacaaatagtacaaacataatacacgggggataatattgttcctgcctttagttctatgctaatagcccggagttaacattacatttctgcacccaaaaacctcccctcactatcccaaaaactcaaaaggaaatgaaccattaaaccaacaccttattcctgggacactaaatgacctctaatatacgaactcatctggtatattcacatctgatctgatactaatcagaaggaaccgagcagaacagacataaataagtaaagacttgcacccgattctctcacgccgaatactgtgatctcaaaggagcatatcggacctggcaggcagtcttctgtagaagttgaaaggcacggagggcatcctgctgcggaaccggggatgtcgaagcaggtaaagcatgcctatcaccatcagaacctggaacggc

SEQ ID NO: 78275 - DNA, 453 bp, Zea mays
  Clone ID: LIB3079-018-Q1-K1-F10.R2
gccgttccaggttctgatggtgataggcatgctttacctgcttcgacatccccggttccgcagcaggatgccctccgtgcctttcaacttctacagaagactgcctgccaggtccgatatgctcctttgagatcacagtattcggcgtgagagaatcgggtgcaagtctttacttatttatgtctgttctgctcggttccttctgattagtatcagatcagatgtgaatataccagatgagttcgtatattagaggtcatttagtgtcccaggaataaggtgttggtttaatggttcatttccttttgagtttttgggatagtgaggggaggtttttgggtgcagaaatgtaatgttaactcccgggctattagcatagaactaaaggcaggaacaatattatcccccgtggattatgtttgtactatttgccgtcaatttggtttgtgtttc

SEQ ID NO: 78276 - DNA, 452 bp, Zea mays
  Clone ID: LIB3079-018-Q1-K1-F11.F1
gaccgcagaaatctagctggttcattttagtggtagccaaaacaaaattaaaaccgaaatagtttgtcccgaacacggaggacaggtactggtaaagtttgagttacacaggaatacatggcacggctaccgcaaactacttcatcgagcgaccctgcttccttgcgaaatatgaaagcaacgatgcctgcccatccgaagctgcttttacagctttttccttcctggtaagctgagagggtttcatgctagcttcgacttgagtgtcctcgatctttctcttgaatcccaaatcacgttgtgtttccaaagtggcaccagccagagtcatagtatcttcatgctcgatgctccacggtgtctcgaaaacttgtggttccaaggtgacaggttcatcctttatagtacaattagtagtttgcttctctcgggactggtgttggttgccgtcc

SEQ ID NO: 78277 - DNA, 448 bp, Zea mays
  Clone ID: LIB3079-018-Q1-K1-F11.F2
ggaccgcagaaatctagctggttcattttagtggtagccaaaacaaaattaaaaccgaaatagtttgtcccgaacacggaggacaggtactggtaaagtttgagttacacaggaatacatggcacggctaccgcaaactacttcatcgagcgaccctgcttccttgcgaaatatgaaagcaacgatgcctgcccatccgaagctgcttttacagctttttccttcctggtaagctgagagggtttcatgctagcttcgacttgagtgtcctcgatctttctcttgaatcccaaatcacgttgtgtttccaaagtggcaccagccagagtcatagtatcttcatgctcgatgctccacggtgtctcgaaaacttgtggttccaaggtgacaggttcatcctttatagtacaattagtagtttgcttctctcgggactggtgttggttgc

SEQ ID NO: 78278 - DNA, 218 bp, Zea mays
  unsure at all n locations
  Clone ID: LIB3079-018-Q1-K1-F11.R1
aggtcccgtcgcctccgtcaactgccgccgcaggcccgctgcaggcttccatgtgtggtagggccggtgtacctcagctcggccgaggttgccagggccttcggcttccccaccatctccgccaacgcgggcgcggtcgagacggccccctgtgccgactctctagcttaaccgtttccggccgtcgtacaatgtgttgtctcnggctgaacctgcct

SEQ ID NO: 78279 - DNA, 648 bp, Zea mays
  unsure at all n locations
  Clone ID: LIB3079-018-Q1-K1-F11.R2
aggtccccgtcgcctccgctcaactgccgccgcagggcccgctgcaggcttccatgtgtggtagggcccggtgtaccctcagcccggccgaggttgccagggccttcggcttccccaccacctccgccaacgcgggcggcggtggagacggccccgctgtgccgacgctccatcttaaccgtttccggccgtcgtacaatgtgttgcctggggcgtacctgcctgtgggcgccatgcgggcactaccaggttgcgcccacggaggaggaggttcggatggggaggggccggtgatccagtgcatgaagtgggggctggtgcccagcttcaccggcaaggccgagaaacccgactatttcaggatgttcaatgccagatcagagtccgtaaaagaaaaggtttcattccgtcgactaattcaaaaaaataggtgccttgttgcagtagaagggttttatgagtggaaaaagaatggatcaaaaaaacagccatactacatacatttncaagatcataggcctcttgtctttgcagccttgtatgatgcatggacaaattcagaaggagagatcacccatacattcactattntgactacacatgcctcaacttctctaaattggctncatgatagaatgcctgttatct

SEQ ID NO: 78280 - DNA, 429 bp, Zea mays
  Clone ID: LIB3079-018-Q1-K1-F9
gcgtccagatggaactcaggacattgtaaatcagctgtagcaagtatatggtgaagatttggttttagtgcgagctaggccaaggaagctagggcttggtaccgcatatttacatggactaaagcatgcctcaggggaatttgtcattatcatggacgcggacctatctcaccatccaaaatacttgccaagctttattaggaagcaaaaggaaactggagctgacattgtaactggcacacgttatgttaagaatggtggtgtccatggttggaatctcatgcgcaagctgactagcagaggtgcaaatgttcttgcacaaacgttactgcagcctggagcttcagatttaaccggatcatttaggctatataagcgagatgtcctggaagacttaatctcctcatgtgtcagcaagggctacgtgtt

SEQ ID NO: 78281 - DNA, 104 bp, Zea mays
  Clone ID: LIB3079-019-Q1-K1-A8
aaaaaaaaaaaaaaaaaaaaaaaataaattaaaaaaaaaaaaaaaaaaaaaaaaaaaggaagaaaaaaaaaaaaaaaaagaaaaaaaaaaaaaaaaaaaaaaaa

SEQ ID NO: 78282 - DNA, 139 bp, Zea mays
  Clone ID: LIB3079-019-Q1-K1-C2
gccagtctgtcgctggacaatgatgagttctagagcaattgtggactgtgtttgtaaggggaggcagatgctagcgttgatcatttttcactgtacgtttcttccttctggttggtggtacgtgctctgctgcaatttc

SEQ ID NO: 78283 - DNA, 221 bp, Zea mays
  Clone ID: LIB3079-019-Q1-K1-D9
gacgattccacccatgttcttacagcaaccctttgttggtgctgcattctggatagagatatttgtgttgtaccaaataatgagttgacatgccatcgcgtgtgactcattattattaacaataaaacaagtttccttttatcaaaaaaaaaaaaaaaaaaaaaaaaaaaaaaaaaaaaaacaaaaaaaaaaaaaggcgcaggggctgtaggtttacaagt

SEQ ID NO: 78284 - DNA, 86 bp, Zea mays
  Clone ID: LIB3079-019-Q1-K1-H2
aaaaaaaaaacataaaaaaaaaaaaaattaaaaaacaaaaaaaaaaaaaaaaaaaaaaagaagggcttaaaaaaataaaaaggaaa

SEQ ID NO: 78285 - DNA, 462 bp, Zea mays
  Clone ID: LIB3079-020-A1-F1A
gggacatatagaggagattttttttagctaagcccgaaattcgttctcaagagggatcgaacccgagacctataagtgctgctcggaagtcttaaccattacattagaggaccttttcgcaaaaattgagtaccactgatagatacatcaaagtcaaaggagaactccatgctacacgtaaactgatatcccagaagcatcccagacatcaggtgatgatagatgagatgcgcttccttaaaaagaagtgttaaatcttggagtacatgtctacgaagagtatatttgatcttccaagagaatgcctgcaataagctgtgtcagctgcataataggatcaaggcagagagcagaccaccagtcgaatatgaaatagatatcgttactcatacaaagaaatgatcttcttgtcttgtgctcgcaacaacaaattgttgtataccctcatagtgtaccaagtgg

SEQ ID NO: 78286 - DNA, 461 bp, Zea mays
  unsure at all n locations
  Clone ID: LIB3079-020-A1-R1A
gttggtgtgcgtacaaccacgttcgaggtgtctggtggtggtcatgctaagaggggagacatggccaaggggatatatgggcnaatggaggcttcaggggttgaagcatcaataacgagcaacgtgcttcttgtcattagttatcttctgcaggcttttttacgttcaagagataaatcaaagcctctagaactggggagtggggatatccaaggtcggaaggcaggaaggctcttgattggtgatctagttgcctcggtttgacagaggtggtatcaggaaacgatgagtgacttaggaggatgttgggagagggagatggaaaagtattttcctgttgatatttacacttataacatgctgttacgagggtgctcgagggcaggaaggatggactctgcctgtaggttgtatgaaaggatatgcaggcaagggtatcaaccaaatcgatgggcttttga

SEQ ID NO: 78287 - DNA, 392 bp, Zea mays
  Clone ID: LIB3079-020-E8-F1A
ggaatgagcgcgattgatatttgatcgatactgatggccgcaagcaagattacacaagtcatgattgattacaagcagacgtccagaccataatcaatgatttcgtccatactggcagcaaatccgaggaggagggcagagagagagagagagcgaaaaggaacaaagaaaaaaaaacagatcttgatctggatcacggcggcggcgcaacctactactccgtatatcgcatcctgctccgggcggctactagcccgcgtagacgtggatgccgatggcgatgaggaagatggtgatgagcgcgaagtagaggacgttatggactaagaattccagaccgcatatgagcatgcagcataaatcttagacgctgccccggctcgtcagcgtgc

SEQ ID NO: 78288 - DNA, 462 bp, Zea mays
  Clone ID: LIB3079-020-E8-R1A
gaagagggaggaggggaatcagagaggtctccccgatggcggactggggccccgtgatcgtagcgacggcgctgttcgtggtcctcacgccggggctgctctgcacgctgcccggccggggccccgtcgcagagttcggcagcatgcacaccagcggcctggccatcctcgtccacgccgtcctctacttcgcgctcatcaccatgttcgtcatcggcatcggcatccacgtctacgcgggctagtagccgcccggagcaggatgcgatatacggagtagtaggttgcgccgccgccgtgatccagatcaagatctgtttttttttctttgttccttttcgctctctctctctctctgccctcctcctcggatttactgccagtatggacgaaatcattgattatggtctggacgtctgcttgtaatcaatcatgacttgtgtaatcttgcttgcggccatc

SEQ ID NO: 78289 - DNA, 591 bp, Zea mays
  unsure at all n locations
  Clone ID: LIB3079-020-Q1-K1-E3-N1
acaaggtacacttatttacatgccatccaaagtttttttgtttttcagtttttgtttaattgcaatttctgcaataaacattgtattgatgagctggactggcttcttccaactcagactagggatcaggattgccaagtatagcttcatcaccggagtcgtcttcctcctcgctaagctcttcatcactggacttgtcttccggagtgataccagcgtcctctggtttggcatacttctcacaatattctttcactttctgttcataaacaggacgatcacgcatcatcagtgctgcagcctccccatttaatggatcagaaggatttggatatagtaacagctgtggaaggaatacttcaaaaacatttactagatcaaacattgggctccatgtttggtttatgacatctaaacatacagagccagacatctcatcgacatttgggtgataaatcttgttgatgaagccgatggacggngatttgtaaggatatgcatcaggcagttctaccctaaccttccagacaccgccttggtagatactttcggccggccccttgaattcgacgaaaaaattcctgcatccca

SEQ ID NO: 78290 - DNA, 466 bp, Zea mays
  Clone ID: LIB3079-021-D5-R1A
ccggccccgtcgagcgcctcttcttcttccgccacccggagccggcctccactctcccgctcctccgctcctcgctctccctcgcgctccgccgcttctacccactcgccggcaccatcaggccccacgcgcccttcctctgctcctacacccatggtaccgatgccctcaccatggtcgtcgccgagtcgaacagccccgacgatttcgacagcctcgtagccaggtcacgcagggacctggacaggatccgccccctcgttccgcagttgccgccgccgggggaagacggagcgttcgcgctcgccgccgtgcaggccactgtcttccgaggccgtggcctctgcctcggcgtctccgtccaccacgctgcctgcaacgatgcctccaccatgcatttcgtccgcacctgggccgctacctgccgcctaggactcgagaacgacgacggatccgaggacgccgt

SEQ ID NO: 78291 - DNA, 293 bp, Zea mays
  unsure at all n locations
  Clone ID: LIB3079-021-Q1-K1-B4
cccacgcgtgcggttgatcctgaggcatgtacgtgcttgcttgacaccaatgcttatggtgagattatgtagtactgtatgtgcacagattgatggagtacacaaactaagctcgtatcgctagagaatcatggtactatgaataggcatttggatcagcgtgtttagttctagtaagataataccacttctcaattaatgcaattccagcctcccaatgttttgtcaaaaaaaaaaaatnnttaatataaaaaattcaaaattaataaaatataaaaatataaaaaataaaa

SEQ ID NO: 78292 - DNA, 466 bp, Zea mays
  Clone ID: LIB3079-023-B2-F1A
ggcacaaacacgcgctgctccgataacaccgggaaataaaccaatgcacgcacggacctgacttgtacaaatagcgtgcggtacagaccggacaggacacatgttttgcccccaaagcaactcttacaaaatagaccgaccaagaatgaaatgcaaagacaatgcaagcggccaaagggaaaagaatgctaggaaattcacaacctaccagcagcagcagggaggatatgtctgacataaatggacttggccaccctgatcgatacaaaaataatcctgtgacaacgcgattcgagcccgctctttcttactggagcagcagcaagaaactgcgccttttgtcccacgtggccatctgaccaaactttgatgcatgggatggatacaggggaggaaatgatgggccacatatcataggcatgccatgcacaggaatctgtgagcatgtcatgcgataatagaacct

SEQ ID NO: 78293 - DNA, 463 bp, Zea mays
  Clone ID: LIB3079-023-B2-R1A
gcgtgactatatcatgagagtagtttgtgaagcgacacagtctccagaggtgaagataaggcaggccgcctttgagtgtttggtggctatctcgtctacttattatgataagctggcaacagacatgcaggatatatttaatataactgcaaaagctgtgaggggagatgaggagtcagttgcactccaggctattgaattctggagttccatatgcgatgaggaaattgatattctggatgagtacagcagtgaatttacagctgattccgatgttccttgctactactttatcaagcaggctcttcctgccttggtgcctatgttgttggaaactctcctcaagcaagaggaagaccaagacttggatgaaggtgcttggaatcttgcaatggctgggggaacttgtttgggcctggtggcaaggaccgttggtgatgacattgttcctcttgtaatgcct

SEQ ID NO: 78294 - DNA, 467 bp, Zea mays
  Clone ID: LIB3079-023-C7-R1A
ggtctcggtgaccgcgggcgacttcgtgaccgagacgctcaccttcgcgggatgcgcccgcgtggcgcgcgtggcctcgggtgcggccacgacaacgagggcctgttcgtggccgcggcggggctgctggggctcgggcgcggcgggctgtcgttcccgacccagatctcccgccgctacggccggagcttctcctactgcctcgtcgaccgcacctcctccggcgcgggcgccgcgccgggctcccaccggtcctccaccgtcagcttcggggcgggctccgtcggcgcgtcgtcggcgtccttcaccccgatggtccgcaacccgcgcatggagacgttctactacgtgcagctggtgggcatcagcgtgggcagcgcgcgcgtcccgggcgtggccgagtcggacctccggctggacccgtccacgggccgcggcggcgtgatcgtggactcgggcacctccgt

SEQ ID NO: 78295 - DNA, 486 bp, Zea mays
  Clone ID: LIB3079-023-H5-F1A
taattttttttttttttttttttttttttttttttttttttttttttgcggtaattgcaacgggattccacattacagcatccattacactccacattcaaaagaacaaaagttaaccaatggcaggtttttcccatcaaactattattcttcatcaaatccgtaacataaaagggtatggcagaggcgcacaagcttgaccgagccaggggaatgaaggaaggctcacagcgtcgaaagccgcaccttgccattcgtcgcggcaggccattacgggatgtcccacggcttaggctcggggacagcgacgaccatgccatgcagctccggcgtgaggacgacctggcagcccaggcgcgcgtgcttgttgagctcgcggttcctggacgcgcgcgtgaacacgtaccgctcctcgtaggacggtggcggcagcttgtcgagccactcctgcgcgatgtggacctcgcactcggcggacacgcgtcg

SEQ ID NO: 78296 - DNA, 314 bp, Zea mays
  Clone ID: LIB3079-023-H5-F2A
gcgggaattgcaacgggattccacattacagcatccatttcactccacattcaaaagaacaaaagtttaccaatggcaggtttttcccatcaaactattatttttcatcaaatccgtaacataaaagggtttggcagaggcgcacaagcttgaccgagccaggggaatgaaggaaggctcacagcgttgaaagccgcaccttgccattcgtcggggcaggccattacgggatgtcccacggtttaggctcggggacagagacaaccatgccatgcagtttcggcgtgaggaccacctggtatcccaagcgcgcg

SEQ ID NO: 78297 - DNA, 91 bp, Zea mays
  Clone ID: LIB3079-023-H5-R2A
gactggagaacactaaccaagcatgagttagtttgtgggaacttcgcgggctgtggcattgtccgcaggaattctctctggtgttgacgag

SEQ ID NO: 78298 - DNA, 87 bp, Zea mays
  Clone ID: LIB3079-023-Q1-K1-A10
cacacgcgtacgcccacgcgtccgaaaaaaaaaaacacaaaaataaaaaaaacaagaaggaataactagaacgcaaggaaatataaa

SEQ ID NO: 78299 - DNA, 389 bp, Zea mays
  Clone ID: LIB3079-023-Q1-K1-F7
ggctctcgggccaacttgcactctcaggttcagcatcaagccagacatggccacgcggggctaccagccggcagctgctcccgctaggagctgacgtcttgcatcaactgggactccctcaatttgttactgcgacgcacatcacttaggtgattaaggcggactggattactaccgatgaagtgaagatccatctccacaagcaccggatgcacagcataagatccacatgcttacctgctacattcagccagacagttatgctggctcaacggcctttcgatctgctgctgcatcaggagcacagcatttggcagagcgtacactccgagagcccgctatacgtctgtcgatccggtggatcggccaccgtcactggatatagctga

SEQ ID NO: 78300 - DNA, 478 bp, Zea mays
  Clone ID: LIB3079-024-D6-F1A
ctctcagaaaagtttacaacattacaaccataaagatcagcactaacattatgagtttgttatcatgagtggcatgtcatgcgtgccagacaaacaacaggtacattcatacatagcataacttacaacatgatacaagctacagagcacggtcaatcttacatatagaaaaaaaaagagagggaatccttcttaatgcagtttctgtgcggaagcgggatcaagcttgagccctcgtttgaggatttgcatggaaggccgactgcctattttgacccaccagcagatttaacgacagagaagtagacaccgtttcctgaccaggctcccctatgcttagctttgacatgctcacaagttcatcaacattaattggattcttggaatgaactgcaacaggcttgacaatctcgtgcgtttcttgaggcagatcacctccatcttcctgatttggccagaaagggactgagaattgcaa

SEQ ID NO: 78301 - DNA, 463 bp, Zea mays
  Clone ID: LIB3079-024-D6-F2A
ctctcagaaaagtttacaacattacaaccataaagatcagcactaacattatgagtttgttatcatgagtggcatgtcatgcgtgccagacaaacaacaggtacattcatacatagcataacttacaacatgatacaagctacagagcacggtcaatcttacatatagaaaaaaaaagagagggaatccttcttaatgcagtttctgtgcggaagcgggatcaagcttgagccctcgtttgaggatttgcatggaaggccgactgcctattttgacccaccagcagatttaacgacagagaagtagacaccgtttcctgaccaggctcccctatgcttagctttgacatgctcacaagttcatcaacattaattggattcttggaatgaactgcaacaggcttgacaatctcgtgcgtttcttgaggcagatcacctccatcttcctgatttggccagaaagg

SEQ ID NO: 78302 - DNA, 739 bp, Zea mays
  unsure at all n locations
  Clone ID: LIB3079-024-D6-F3A
ctcctcttcctgatttggccagaaaggaactgagaattgcaagaacggtgagaaataagctggaacaatcatcggataggtaggctgtaaactctcgggcataagagctgaagctgcagaactctccgcaacagcagaagtatctgactccatcgattccacctcctcctcctcctccacagggggaggcagtggtggttgatttaacactgaggtctctggctcttgacttccaggaaggggtggaaggtccatggactcatcaggcaccatgtcaaaaaggctagaccttctcttccttctgctcatatttgattgacgtataaaatatttttgagcatgacttgctacttgagtaggtgttcttgagaccacgaaattacgagaaatccctcgccaatcacctttcccaagcttttgtaatcccagcaaaaacctccggtgttcttcttcagtccaaggaacacctttcttacgctcgcggctggcggaggacgacccctggacgaagtcgtcggaggcgtagcccccgccgccgtcggcgaggtcgggcccgtcggcgggcgacgcgccgccgctggttgaccccgcggagaggagggagaggttccccatgcttgcgctcttgcggatggccgagccatcggtgaggcgcaccccgaagatcttgaccccgcggttggngcacgtccgcgagttgtgcccgttgtggctgcagtgcgagcaccgncgcgtcatc

SEQ ID NO: 78303 - DNA, 443 bp, Zea mays
  Clone ID: LIB3079-024-D6-R2A
gcttcctcgcaccggctccggtcctcctcccatcaccatcaccaccgtcgttcctctcacgagtcccgacacacgcaaaccgcacgaaccctggctggcggcgggatgacgcggcggtgctcgcactgcagccacaacgggcacaactcgcggacgtgccccaaccgcggggtcaagatcttcggggtgcgcctcaccgatggctcggccatccgcaagagcgcaagcatggggaacctctccctcctctccgcggggtcaaccagcggcggcgcgtcgcccgccgacgggcccgacctcgccgacggcggcgggggctacgcctccgacgacttcgtccaggggtcgttctccgccagccgcgagcgtaagaaaggtgttccttggactgaagaagaacacctgaggtttttgctgggattacaaaagcttgggaaaagggg

SEQ ID NO: 78304 - DNA, 727 bp, Zea mays
  unsure at all n locations
  Clone ID: LIB3079-024-D6-R3A
caccggggtttttgctgggattacaaaagcttgggaaaggtgattggcgagggatttctcgtaatttcgtggtctcaagaacacctactcaagtagcaagtcatgctcaaaaatattttatacgtcaatcaaatatgagcagaaggaagagaaggtctagcctttttgacatggtgcctgatgagtccatggaccttccaccccttcctggaagtcaagagccagagacctcagtgttaaatcaaccaccactgcctccccctgtggaggaggaggaggaggtggaatcgatggagtcagatacttctgctgttgcggagagttctgcagcttcagctcttatgcccgagagtttacagcctacctatccgatgattgttccagcttatttctcaccgttcttgcaattctcagttcctttctggccaaatcaggaagatggaggtgatctgcctcaagaaacgcacgagattgtcaagcctgttgcagttcattccaagaatccaattaatgttgatgaacttgtgagcatgtcaaagctaagcataggggagcctggtcaggaaacggtgtctacttctctgtcgttaaatctgctggtgggtcaaaataggcagtcggccttccatgcaaatcctcaaacgagggctcaagcttgatcccgcttncgcacagaaactgcattaagaaggattccctctctttttttttctatatgtaagattga

SEQ ID NO: 78305 - DNA, 487 bp, Zea mays
  Clone ID: LIB3079-024-E4-F1A
gctactcaatacagtgactgacacatttaatttcgcataggagtaagctggctgctttggttctggcaatgtgatgccatcactgctaagagttgcaacaacatcaggcattgtaggatgatctattgttttttttctcataacacacaacaataccacagcaactcagcaaggtatttcatcagctcttccagttcgtagtcatcaccaaatgattgatcattgaacttattccatctcctgtctttccacagttcccaggttttatggaaggaaataatgtagaacaccatacagatacaccattaatactaaactgaaaacatctgacttgatcgagagaaggccatcagatgcaattcattagccatgtatccaccttactatgtgcccacaagtctgctggctgttgcttgagtggcatccgatggaaatatccttgccatcccaacatcagaaatcttagggtttagatcagaaatctaac

SEQ ID NO: 78306 - DNA, 470 bp, Zea mays
  Clone ID: LIB3079-024-E4-R1A
agtcaaagtagctgatggtatagcccagggactcctggaccttcacaacctgtcgtgggtacgcatcgtccatagggtcttgagagcgagtagaatccgtggttaggattgctggatctaaaccctaagatttctgagtgttgggatggcaaggatattgccatcggatgccactcaagcaacagccagcagacttgtgggcacataggtaaggtggatacatggctaatgaattgcatctgatggccttgtctcgatcaagtcagatgttttcagtttagtattaatgggtgtatctgtatggtggtgctacattattgccttccataaaacctgggaactgtggaaagacaggagatggaataagttcaatgatcaatcatttggtgatgactacggactggaagagctgatgaaataccttgctgagttgctgtggtattgttgtgtgttatgagaaaaaaaacaat

SEQ ID NO: 78307 - DNA, 114 bp, Zea mays
  Clone ID: LIB3079-024-Q1-K1-A2
aaaaaaaaaaaaaaaaaaaaaaaaaaaaaaaaatttttaaaaaaaaaaaaaaaaaaaaaaaaaaggaagaaatattaaaaaaaaaataaaaaaaaaaaaaaaaaaaaaaaaaaa

SEQ ID NO: 78308 - DNA, 91 bp, Zea mays
  Clone ID: LIB3079-024-Q1-K1-B3
accacgcgtacgcccacgcgtacgcccacgcgtccgataccttattttaaaaaaaaaagaacggaggaagcataatcagacaatgaaaact

SEQ ID NO: 78309 - DNA, 411 bp, Zea mays
  Clone ID: LIB3079-024-Q1-K1-F8
cggcagttaggcttgctaagaggccagaaaacgccggaaagctatttgttgtcgtgttccggggcttcggcgagcgctacctctcatcggtgctgttccagtccatcaagaaggaagcggagagcatggtggtcgagccctagagcacaaaattctgggcttctggcaaactatttcctgagacgttcaccatttccatcacagaaaaataaagctcgggtgccttctgttgatttcgacgtacatttccctgccgatggtgtccagcccactgttgtcgctggagaacacgtcgtttttagacttgtgatattttactactgttttgacactcgttgtatttctgtatatcgcgtcagactgtgaaataaaagcagtacagtgtgtttcttgcagaaaagatcatcaaca

SEQ ID NO: 78310 - DNA, 607 bp, Zea mays
  unsure at all n locations
  Clone ID: LIB3079-024-Q1-K1-H4.F2
cgttaaaaattcttcgatatatgttttcatagttccatccgaaaagccactaaaagcaggttcaggggtgctttcagatttacactacgagaaagtcggcttttagaaaaaagctgcttcctgtatccagccctttggttggcttttaacttttagggggcaaaagccaaagccaaaagtcaaaccaaacacaccctaaatctaacctcaaactcctaaccgctactagagctgctcatcaccggaccttatcattaagccacgccggagctgctcggctccatagctccgccacatgattgctgacatgtatgctggtgtggattccgtacgtgcactagttgagttgagctccgttgatctaagggtgttatattacttggtggcttgcccagtattccgttaccaaggtgaggagcaactgatggaatctcaagcgacaatccgtagccaaaaccagaaggaatgattggtggcttgcccagtattcccttgccaaggtgaggagcaactgatggaatcccaagcgataatccatagccaaaaccagaaggaatgattcgtggccatcgaataatgngcacaaactgatgaatgctagactgat

SEQ ID NO: 78311 - DNA, 211 bp, Zea mays
  Clone ID: LIB3079-024-Q1-K1-H4.R1
aagaatttggggaacggaccccgcaaggcacagtatgctgtgctccagaagagtgcaaagcatgctgcgtagtgctactggcagtgattcattacccactcctaacaaggtcttgcatcatgcactccattatcgagttgctggccagcagtctaggattcatcagtttctgcggatgattctatggctagcaatcattccttctcggctt

SEQ ID NO: 78312 - DNA, 663 bp, Zea mays
  Clone ID: LIB3079-024-Q1-K1-H4.R2
aaggaattgggaacggaccccgcaagggggaagatgtgtgctccagaagagtgcaaagcatgctggtagtgctactggcagtgattcattacccactcctaacaaggtcttgcatcatgcactccattatcgagttgctggccatcagtctagcattcatcagtttgtgcccattattcgatggccacgaatcattccttctggttttggctatggattatcgcttgggattccatcagttgctcctcaccttggcaagggaatactgggcaagccaccaatcattccttctggttttggctacggattgtcgcttgagattccatcagttgctcctcaccttggtaacggaatactgggcaagccaccaagtaatataacacccttagatcaacggagctcaactcaactagtgcacgtacggaatccacaccagcatacatgtcagcaatcatgtggcggagctatggagccgagcagctccggcgtggcttaatgataaggtccggtgatgagcagctctagtagcggttaggagtttgaggttagatttagggtgtgtttggtttgacttttggctttggcttttgcccctaaaagttaaaagccatccaaaaggctggatacaggaagcagcttttttctaaaagccgactttctcgt

SEQ ID NO: 78313 - DNA, 184 bp, Zea mays
  Clone ID: LIB3079-025-Q1-K1-E12.F1
agggaagaattatattttgaggctcaagaaaataaaccaaaaactttaccagtgtcaaataatgaattgtctcttgtatattccattccatataattcctggcttcgcgcacatcacacacggatcagcaggggactaatgaaccgtgcttggatttccgatcctgctcactaactcggtcggg

SEQ ID NO: 78314 - DNA, 563 bp, Zea mays
  Clone ID: LIB3079-025-Q1-K1-E12.F2
agggaagaattatattttgaggctcaagaaaataaaccaaaaactttaccagtgtcaaataatgaattgtctcttgtatattccattccatataattcctggcttcgccgcacatcacacacggatcagcaggggactaatgaaccgtgcttggaattccgatcctgctcagtaaccggccgggacaccgccttttctggggtcgctaacggcggtgaggtcgccttggcgcccgacgttgtgcaccacaagctggcttatggtccctccagctatcggcgtcaggacgtggcctctcctgtgcaggtcggccctcgtggcggcgtcgagctcgaagtggtcgccggtcaccgtcgtccagttctcgtacctgacctcgtttgggatcagctggtgatacacccttggcgccatgaccgaagccaacgggtccatgttcttgacgaaatggttgatgaacacctcgatcgttccggccggggatcatgccgccaccactggcaccgactgcagccaccagcttcccgtccttgacaccacggtcggagccatggaagaagaga

SEQ ID NO: 78315 - DNA, 642 bp, Zea mays
  unsure at all n locations
  Clone ID: LIB3079-025-Q1-K1-E12.R2
cccacgcgtccggacttctccatgccagcgaacgcgtccgagaattctccaccgccggcacctgccaacttcgtcagccccttgaaacggcctctctcttccatggctccgaccgtggttgtcaaggacgggaagctggtggctgcagtcggtgccagtggtggcggcatgatccccgccggaacgatcgaggtgttcatcaaccatttcgtcaagaacatggacccgttggcttcggtcatggcgccaagggtgtatcaccagctgatcccaaacgaggtcaggtacgagaactggacgacggtgaccggcgaccacttcgagctcgacgccgccacgagggccgacctgcacaggagaggccacgtcctgacgccgatagctggagggaccataagccagcttgtggtgcacaacgtcgggcgccaaggcgacctcaccgccgttagcgaccccagaaaaggcggtgtcccggccggttactgagcaggatcggaattccaagcacggttcattagtcccctgctgatccgtgtgtgatgtgcggcgaagccaggaattatatggaatggaatatacaagagacaattcattatttgacactggtaaagtntttggtttattttcttgagcctcaaatat

SEQ ID NO: 78316 - DNA, 98 bp, Zea mays
  Clone ID: LIB3079-025-Q1-K1-E5
aaaaaaaaaaaaaaaaaaaaaaaaaaaaaaaaaaaaaaaaaaaaaaaaaaaaaagaaggggaaaaaaaaaaaaaaaaaaaaaaaaaaaaaaaaaaaaa

SEQ ID NO: 78317 - DNA, 470 bp, Zea mays
  Clone ID: LIB3079-025-Q1-K1-F12.F2
aaagatgaagataaatttcaatcttattatgttgccttgtttttgataaccaaaggagtcaaaaacaagtgcccaaaaattacatatgatcctctcaagttccctgtctgaaaacttgcatgtatcgttttcctataaaaagacagtttgcaataagtttccgcgcagcagagggttctcctgatttacagacaattcccctcgtttggtatgcatatcagttatgtataacccaaaccaaaacctccaatgtggagtgtatcctcacaactggaagaaagccccctcctttacttctgttgctttaatatgggaaagaccctgtcaacttcatatgatcaagggttcttttcaagccatagcgctcaacagccggatagccagctctaaaaccacctccgtatgcctcggaagaatccgtttcgatctggtgcttgatgaatgccccaagcttcttccggacgcgtggg

SEQ ID NO: 78318 - DNA, 481 bp, Zea mays
  Clone ID: LIB3079-025-Q1-K1-F12.R2
cccacgcgttcggaagaagcttggggcattcatcaagcaccagatcgaaacggattcttccgaggcatacggaggtggttttagagctggctatccggctgttgagcgctatggcttgaaaagaacccttgatcatatgaagttgacagggtctctcccatattaaagcaacagaagtgttggagggggctttcttccagttgtgaggatacactccacattggaggttttggtttgggttatacataactgatatgcataccaaacgaggggaattgtctgtaaatcaagagaaccctctgctgcgcggaaacttattgcaaactgtctttttataggaaaacgatacatgcaagtttacagacagggaacttgagaggatcatatgtaatctctgggcacttgtttgtgactcctttggttatcaaaaacatggcaacataataagatcgaactctatcttcacctttaaaaaaaacaa

SEQ ID NO: 78319 - DNA, 75 bp, Zea mays
  Clone ID: LIB3079-025-Q1-K1-G10
aaaaaaaaaaaaaaaaaaaaaaaaaaaaaaagaataaaaaaaaaaaaaaaaaaaaaaaaggaaaggaaaaaaaca

SEQ ID NO: 78320 - DNA, 87 bp, Zea mays
  Clone ID: LIB3079-025-Q1-K1-H11
aaaaaaaaaaaaaaaaaaaaaaaaaaaaaagaaaaaaaaataaaaaaaaaaaaaaaaaaagaaagtgaaaaaaaaaaggatgcataa

SEQ ID NO: 78321 - DNA, 508 bp, Zea mays
  Clone ID: LIB3079-026-C12-F1A
tcgcgatctagaaccggacgcgtgggcaacccccgatgcgatgggtgcccctgcccctcgatagtcgcgccgctctcctgcccgttcggccgttccccatttgcctcgtcgcccaccgccccattagcgccgccctcccctatccgacccaacgccgccgccgccgccgcatagacctcgccggcgcctctgcgcgccccgtggcctccagaggtgctattcgcgcgcgatccgccgctgcgtccgtcgctctggcatcgattcggcggcgctgggagtatgtctctggtgcaagtgtgctgaagatgaaggagaggagctctttatgtgaaagtgcagccgatggaaactggggtttgaaatataaaaggaaaagaagcaagttaaccgttagcccatctaatgagaatgaggctacctcaccaacatctgactctccaatgagccatggttccaccaaaaagaagttgaagcatgacactaacatttctccatcagccaacgagat

SEQ ID NO: 78322 - DNA, 495 bp, Zea mays
  Clone ID: LIB3079-026-C12-F2A
tcgcgatctagaaccggacgcgtgggcaacccccgatgcgatgggtgcccctgcccctcgatagtcgcgccgctctcctgcccgttcggccgttccccatttgcctcgtcgcccaccgccccattagcgccgccctcccctatccgacccaacgccgccgccgccgccgcatagacctcgccggcgcctctgcgccgccccgtggcctccagaggtgctattcgcgcgcgatccgccgctgcgtccgtcgctctggcatcgattcggcggcgctgggagtatgtctctggtgcaagtgtgctgaagatgaaggagaggagctctttatgtgaaagtgcagccgatggaaactggggtttgaaatataaaaggaaaagaagcaagttaaccgttagcccatctaatgagaatgaggctacctcaccaacatctgactctccaatgagccatggttccaccaaaaagaagttgaagcatgacactaacatttctcca

SEQ ID NO: 78323 - DNA, 466 bp, Zea mays
  Clone ID: LIB3079-026-C12-R1A
agatcgcgagcgccgccctttttttttttttttgatccagttttgtcttgtgtggagttcctggtcttaaaggagacttttgtatgcgaaggtggactacctgatgtcgtacctgcatatgtccttgtacttttttcatgtttagaagtgccaacctctgcattacctaacatcttcaagctaccttttttcggacggcatcttggacattgccacttcccagggggtagacgcttaagaggaggattgaggcattccaagtggtaaacacgaggacagctatcacaacatagcaaattgccaccaagatcacattctacacactcaaaaaaatacccatcgtgtcctcttatcttcttggctgatggagaaatgttagtgtcatgcttcaacttctttttggtggaaccatggctcattggagagtcagatgttggtgaggtagcgtcattctcattagatgggc

SEQ ID NO: 78324 - DNA, 422 bp, Zea mays
  Clone ID: LIB3079-026-C12-R2A
agatcgcgagcgccgccctttttttttttttttgatccagttttgtcttgtgtggagttcctggtcttaaaggagacttttgtatgcgaaggtggactacctgatgtcgtacctgcatatgtccttgtacttttttcatgtttagaagtgccaacctctgcattacctaacatcttcaagctaccttttttcggacggcatcttggacattgccacttcccagggggtagacgcttaagaggaggattgaggcattccaagtggtaaacacgaggacagctatcacaacatagtaaattgccaccaagatcacattttacacactcaaaaaaatacccatcgtgtcctcttatcttcttggctgatggagaaatgttagtgtcatgcttcaacttctttttggtggaaccatggctcattgg

SEQ ID NO: 78325 - DNA, 388 bp, Zea mays
  Clone ID: LIB3079-026-Q1-K1-A6-F2A
aaaatctgtggagaaggctttattattagctcataatacttttgatgcatcaataggcctctcccacctcacattagtctcaacattgacttcatattatacaaccctaagaaggttgatcggctgcaacaattgaaatctaaagactacgtcaagcgcttccctcttgcgatatcatcagtttgctggaaccttgtagcttccgcactggaagccatgctcaaatggccttttacactgctcagcaacatacacaaccttctccatgcacacaaccttctcagtttctttggtgaccttggagcacaagcaagaaacgtttgccttcttgatgacaccacagcaagcatccgaaggagggacctttggattagctgggaacattacg

SEQ ID NO: 78326 - DNA, 413 bp, Zea mays
  Clone ID: LIB3079-026-Q1-K1-A6-R2A
acgagaccaaaaaacggttcagtgaacaacttcgtgacgaaggtgaatccttcagggcagtttttgacaagacaacacaacacatatcttttagtaacctttcaataggcgtcccccaagaactagtaaacatggcaaaactgttgagcctgttcttagccctctcctttgtagcagctatgtttgccataggctctcatgctgatggagactgtgagaatgacctccaaagcctgataagtgactgcaagacatacgtgatgttcccagctaatccaaaggtccctccttcggatgcttgctgtggtgtcatcaagaaggcaaacgtttcttgcttgtgctccaaggtcaccaaagaaactgagaaggttgtgtgcatggagaaggttgtgtatgttgctgagcagtgtaag

SEQ ID NO: 78327 - DNA, 193 bp, Zea mays
  Clone ID: LIB3079-026-Q1-K1-A6.F2
accctgtagtggggtttttaataattaatttttttttttgtgggttttttaaaatctcgcggagaaggccctattattagctcataatactcttgaggcatcaataggcctctcccacctgacattagtctcaacattgcacttcatattatacaacggggggggggtacgtcggctgccacacttgaaatct

SEQ ID NO: 78328 - DNA, 87 bp, Zea mays
  Clone ID: LIB3079-026-Q1-K1-A6.R2
acgagtctaaaaaacggttcaaacccggtcttggggacgaaagtgatatccttcagggcagtgtttgacaagacagcacaacatata

SEQ ID NO: 78329 - DNA, 374 bp, Zea mays
  Clone ID: LIB3079-026-Q1-K1-D10
gctccctgtcgccttctgccgccatcccttcgccgtccgtgtcggcgtggtggggcggggtgcggctgtgggcggaccagacctcggcgaacgtgtcggcgtcggtgtcgctgggcgcggagaagtcggacgcgcgcatgtcccgcggcgcgcgggtgtcgcgcatggacatgcaggcagtggtccgcgacgccgtgacggcgcgcacccgggccctgcccgtggacgccagcggcggcgtgtacctggtgctcacgtccccggacgtcgccgtggacgacttctgcgggcaggtgtgcaggtttcactacttcaccttcgcgtccgtggtcgggtccacgctgacgtacgcgttggtgggcaactcggcgcgc

SEQ ID NO: 78330 - DNA, 485 bp, Zea mays
  Clone ID: LIB3079-026-Q1-K1-F4.F2
catcacagtttctaccttgggcatcctttattcaccgctcgggttttcaatgtctaatgtttccaggctataagcatgtgaatcattacagctgaccttggccagacttctaaatggcaacatattctatggtttatatatggtacaatacaaactggcaacgagcacgggatatgacacacataaattgtacactacataggccccaagacttcctgcctgtcctaagctcaatggaagatccttccagaaattttgaacatgtcactgtgaactaaacggaagctcattctgtgctcgggacgcttgcggtctcagctacatcgctgctggctttcacggcgccagcgaaactgcagatcttgttcagggcgctcaggtaagctctgacactggacaccacaatgtccatggatgccccgctcccgctgaaggagcggttgaaggactggccagtcagggcatgtttggcgttgttgctcaca

SEQ ID NO: 78331 - DNA, 542 bp, Zea mays
  Clone ID: LIB3079-026-Q1-K1-F4.R2
ccaaaatttattatcaccacatccccccattaatttaaggggtttttatgtccaccgccgccgccagcgccaactaaacccgcgacgacggtcgaccatggcgtcctcgctgctctcctcccccgctaaacccaccatcaccaccaccaccaaaacgaccccggccccaagacccgcccgctccgcccatgtccatgtcctctccgccgcccgctgcctccgcctccgcctccgcgcgtcgtcgcagcatcctccgcctccgcccaccccgcggtcgcggcggccggattacgtcccgaaccgcatcgacgaccccaactacgtgcgcatcttcgacaccacgctgcgcgacggggagcagtcgccgggcgccaccatgacgagcgcccagaagctcgtcgtcgcgcgccagctggcccgcctcggcgtcgacatcatcgaggccgggttcccggcctcctcccccgacgacctcgacgccgtgcgctccatcgtcatcgaggtcggcaacccggggccaggacccgccggagaggaggacg

SEQ ID NO: 78332 - DNA, 202 bp, Zea mays
  Clone ID: LIB3079-026-Q1-K1-F6.F2
gacgctggatcaagatcaattattgtaattattttgcagctggtgtaacatttgccatgacaagatgaaaaaaaaacaaaattgattttgattaaatgaaacaggatcacagctctcaaaactagtttgtctacatctgagtgtgtgaccatgtatatggtagcagcaggctaaacttattgattgcaggaacaaagggggg

SEQ ID NO: 78333 - DNA, 61 bp, Zea mays
  Clone ID: LIB3079-026-Q1-K1-F6.R1
cagaaaaaacaacggtccagttgacaaaagcccacaacttcatcgccccactctcccaaac

SEQ ID NO: 78334 - DNA, 61 bp, Zea mays
  Clone ID: LIB3079-027-Q1-K1-B1
tccacgcgtccgaaaaaaaaaaaaattatttaaaaaaagaaaaagagaataacaaaggggg

SEQ ID NO: 78335 - DNA, 82 bp, Zea mays
  Clone ID: LIB3079-029-Q1-K1-F3
aaaaaaaaaaataaaaaaaaaaaaaataaaaaaaaaaaaaaaaaaaaaaaaaaaaaaaggaaaataaaaaaaaaaaaaaaaa

SEQ ID NO: 78336 - DNA, 98 bp, Zea mays
  Clone ID: LIB3079-029-Q1-K1-F4
aaaaaaaaaaatataaaaaaaaaaaaataaattaaaaaaaaaaaaaaaataaaaaaaaaaaagggaaaaaaaaaaaaaaaaaaagaaaaaaaaaaaaa

SEQ ID NO: 78337 - DNA, 103 bp, Zea mays
  Clone ID: LIB3079-029-Q1-K1-F8
aaaaaaaaataaaaaaaaaaaataaataaaaaaaaaaaaaaaaaaaaaaaaaaagaaaaaaaaataaaaaaaaaaaaaaaaaaaaaaaaaaaaaaaaaaaaaa

SEQ ID NO: 78338 - DNA, 301 bp, Zea mays
  Clone ID: LIB3079-030-F3-F2A
aggcaaggcatcgcaatgctctcttaaagcagatatatgcggcaatggcgagctcaaattgtagcgcgccatccgttccgtttctttcatgtacattacaagggtttctgctttcagcccagccaatttttccctccaccttaaaaccaagtttgctactccaacaaccgttgcgttgcggtcgccctagctagacgacgatttgggagcactgacggtttgatgcccccatcgggggcgcggggctactgaatccgggcgacctgttcggcggtagcgcgcatgacgccgtccaccaact

SEQ ID NO: 78339 - DNA, 601 bp, Zea mays
  Clone ID: LIB3079-030-F3-F3A
gggttcgagccggcggactgcgccatgagccgtccgcaggaggaggacccgctcaccgccctcagcctctcgcttcccggcacggaccagcggtttcaccaccacagcgccgccgccgacagccacttccaggagctcccgccgtcgccctcctcacccgcgccctcggcctacccgttcagccccgagttcgcggcggcgatgcagcagctgatccgcaccgaggtgcagcggtacatggcgagcgcgggcctgcgcgccggctgcggcgccgttggcgcgaccgacctctgcatgccgcagctggtggacggcgtcatgcgcgctgccgccgaacaggtcggccggatgcagtagccccgcgcccccggcgggggcatcaaaccgtcagtgctcccaaatcgtcgtctagctagggcgaccgcaacgcaacggttgttggagtagcaaacttggttttaaggtggagggaaaaattggctgggctgaaagcagaaagccttgtaatgtacatgaaagaaacggaacggatggcgcgctacaatctgagctcgccattgccgcatatatctgctttaagagagcattgcgctgccttgcc

SEQ ID NO: 78340 - DNA, 661 bp, Zea mays
  Clone ID: LIB3079-030-F3-R2B
cggacgcgtgggggcgcgccgccccttcacggccgacgaggacgcggccatcgcccgcgcccacgcccgcctcggcaaccgctgggccgccatcgcgcgcctgctccccggccgcaccgacaacgccgtcaagaaccactggaactgctccctcaagcgcaagctcggcgccgccgccgccgcgtccggttcggcggtttccgctgacgactccgccgccgccgccgagaccgaggcgcgccggggcaagatgatgatgatgagcatctcgccgcccgacagcccctcggggtcggggtcggggtccgaccgtagcgaccttagcagccacggcgccgggtccgggtccgggtccgggtccggccagatttaccgccccgtggccgcgcgctccggcgggttcgagccggcggactgcgccatgagccgtccgcaggaggaggacccgctcaccgacctcagcctctcgcttcccggcacggaccagcggtttcaccaccacagcgccgacgccgacagccacttccaggagctcccgccgtcgcccttctcacccgcgccctcggcctacccgttcagacccgaattcgcggcggcgatgcagcagctgatccgcaccgaggtgcaacggtacatggcgagcgcggccctgcgcgccggc

SEQ ID NO: 78341 - DNA, 550 bp, Zea mays
  Clone ID: LIB3079-030-F3-R3A
gaacggatctgtccgcgggcgacggctcgacggagcggtcagacgtgcggatcgctctctggaagtgcctgccgtgcggcggtgctgtggtggtgaaaccgctggtccgtgccgggaagcgagaggctgataggcggtgagcgggtcctcctcctgcggacggctcatggcgcagcccgccggctcgaaccctccggagcgcgcggccacggtgctggttatctggccggacccggaccctgacccggacccggcgccgtggctgctgaggtcgctacggtcggaccccgaccccgaccccgaggggctgtcgggcggcgagatgctcatcatcatcatcttgccccggcgcgccttggtctcggccgcgccggcggagtcgtcagcggaaaccgccgaaccgcacgcggcggctgcggcgccgagcttgcgcttgagggagcagttccagtggttcttgacggctttgtacgtgcggtcgaggagcaggcccgcgatggcggcccagcggttgccgaggcgggcgtgggcgcgggcgatggccgcgttc

SEQ ID NO: 78342 - DNA, 65 bp, Zea mays
  Clone ID: LIB3079-030-Q1-K1-D10
gttctagatcgcgcgtcctaaaaaaaaaaaaaaaaaaaaaaaaaaaaaaaaaaaagagaaaaata

SEQ ID NO: 78343 - DNA, 489 bp, Zea mays
  Clone ID: LIB3079-031-H3-F1A
agtctgaaaataccatggcatcgaattctcggcgttctttttgttacattctccaacaaattatggaccaccatgaaatgaagatctcctttctgttatgctcccgaaaggctaatcccttcaatacaggcgctgaagctacagcgataccacaagtattatacaataggcacctggtcgatccatggcgcagggtgggctgccaccgcgcctagaacaggacgctctggctggcgagcaactgatcatgcagagggccacactgcaggccttgttggtcatgaaactccatcctgtaggccggtaccgcagaggtccggttcggtgagctgaagggcagagttccggcaccgtgtcgcttgacgtcggccgccaatgggacctggcatatccccgcggctggagccggagctggagatggagctggtgcgttcgactggctggtgatcagggaggactgggacggcgagggcggctggtcgtccgtca

SEQ ID NO: 78344 - DNA, 477 bp, Zea mays
  unsure at all n locations
  Clone ID: LIB3079-031-H3-F2A
agtctgaaaataccatggcatcgaattctcggcgttctttttgttacattctccaacaaattatggaccaccatgaaatgaagatctcctttctgttatgctcccgaaaggctaatcccttcaatacaggcgctgaagctacagcgataccacaagtattatacaataggcacctggtcgatccatggcgcagggtgggctgccaccgcgcctagaacaggacgctctggctggcgagcaactgatcatgcagagggccacactgcaggccttgttggtcatgaaactccatcctgtaggccggtaccgcagaggtccggttcggtgagctgaagggcagagttccggcaccgtgtcgcttgacgtcggccgccaatgggacctggcatatccccgcggctggagccggagctggagatggagctggtgcgttcgactggctggtgatcagggaggactgngacggcgagggcggct

SEQ ID NO: 78345 - DNA, 439 bp, Zea mays
  Clone ID: LIB3079-031-H3-R2A
gaggaggagcacaggttgttcctcctaggcctgaagaaatacggcaagggggactggaggaacatatcgcgcaactttgtccagaccagaacgcctactcaggtggccagccacgcgcagaagtacttcatcaggctcaactccggcggcaaggacaagaggaggtccagcatccacgacatcaccacggtcaacctgacggacgaccagccgccctcgccgtcccagtcctccctgatcaccagccagtcgaacgcaccagctccatctccagctccggctccagccgcggggatatgccaggtcccattggcggccgacgtcaagcgacacggtgccggaactctgcccttcagctcaccgaaccggacctctgcggtaccggcctacaggatggagtttcatgaccaacaaggcctgcagtgtggccctctgcatg

SEQ ID NO: 78346 - DNA, 310 bp, Zea mays
  Clone ID: LIB3079-031-Q1-K1-B12
ctggcgactcggcagcaggaggtgcttgatggaaactgcaagaagtacgacatgctggaagctctagtgcagaagggagacatcactaaccttgctcaacaatacggagtgaacttgaacgactgatgagtcattcgtgtctttttcccccttccccttggagcgatggcgcaactggtgtgatgatgatggaataggatagcatgccatagttttggtccggtatctggaccctccctctggtgtaaagactatcccaacttaggcttgggcttttcagccttctttggctctccaaaaaaaaaaaaca

SEQ ID NO: 78347 - DNA, 151 bp, Zea mays
  Clone ID: LIB3079-031-Q1-K1-C1
aacattctaaggatcagcagactggcaccacgcatatagctaatgaatcttcggcgtggactataaaaaaaaaacaaaaaaaaaccaaaaaaaaaaaaaaaaaaaaaaaaaaacaaaaataaaataaaaaaaaaaaaaacaaaaaaaaaca

SEQ ID NO: 78348 - DNA, 415 bp, Zea mays
  Clone ID: LIB3079-031-Q1-K1-C11-M1
ctctggcattattggcacgctgcacaatactagttagcttggcataggcccagcagtctgaagatggatgctctgcctctgctgcggtagtttctcgggggcaaaccttccacgcggcatggcatggtattgttgatgtacgattcattcgttggaaaacctggacgtgagtgctggaattgcaccatctggccttttctgtacatgcctgatgtaacggtggtgttgtgtttccccaccaccacctctcttttcacgatgatgacgcagtgcatgtataattgtatgggttaatgacgcagtgcatgccttgcggagtgggccggtagacaaacatttcggcggctggtcacttggtcagtgacccgttgatattattattattattggatctaatgcaacaaccagttctggt

SEQ ID NO: 78349 - DNA, 415 bp, Zea mays
  Clone ID: LIB3079-031-Q1-K1-C11-N1
accagaactggttggtgcattagatccaataataataataatatcaacgggtcactgaccaagtgaccagccgccgaaatgtttgtctaccggcccactccgcaaggcatgcactgcgtcattaacccatacaattatacatgcactgcgtcatcatcgtgaaaagagaggtggtggtggggaaacacaacaccaccgttacatcaggcatgtacagaaaaggccagatggtgcaattccagcactcacgtccaggttttccaacgaatgaatcgtacatcaacaataccatgccatgccgcgtggaaggtttgcccccgagaaactaccgcagcagaggcagagcatccatcttcagactgttgggcctatgccaagctaactagtattgtgcagcgtgccaataatgccagag

SEQ ID NO: 78350 - DNA, 260 bp, Zea mays
  Clone ID: LIB3079-031-Q1-K1-H12
tcggccgttgtgtatagcaggcagcagcaagccatatgctgtagttacacgaagtcccgagcgattacaatgtttcttgctggcctgcatcgttgttctctagatgccctttctttcttgttatttttgtttctactactactacaagtagacgatgttttgtcctgatgatgaatgatacagataagtcatatatatccacatatttcatttttgtcaaaaaaaaaaaaaaaaaaaagaaaatgaaaaaattaaggatt

SEQ ID NO: 78351 - DNA, 454 bp, Zea mays
  Clone ID: LIB3079-032-Q1-K1-A6.F1
gcgcagtatcgatgttatgcattgacttgtaggaagactaataaacctcctctgctggtgaccctgacaagtctaaacaacagtaactaataggctagtaaagttaactagatgttttatactaccacatgcattgaacattcaacctccagaagttcattgtttcagccctacagggctcacaggagtcccagccatacaggactagggctgctccgtgttgtcctcctcttcccactccacgttcttcccctcctcgccatacaaccagcagcaccaagcgaagtacacgaagttcgccacgccgtagcccgtgagcagccagtagtaatagtcgtagcggccgacgttcaagttgtcgacgagccagcccgttcccaccccttgcccgctcgccacctgcaccaccttcacgatgaggggcgcggccaggttgcccactccggaggccatg

SEQ ID NO: 78352 - DNA, 568 bp, Zea mays
  Clone ID: LIB3079-032-Q1-K1-A6.F2
gcgcagtatcgatgttatgcattgacttgtaggaagactaataaacctcctctgctggtgaccctgacaagtctaaacaacagtaactaataggctagtaaagttaactagatgttttatactaccacatgcattgaacattcaacctccagaagttcattgtttcagccctacagggctcacaggagtcccagccatacaggactagggctgctccgtgttgtcctcctcttcccactccacgttcttcccctcctcgccatacaaccagcagcaccaagcgaagtacacgaagttcgccacgccgtagcccgtgagcagccagtagtaatagtcgtagcggccgacgttcaagttgtcgacgagccagcccgttcccaccccttgcccgctcgccacctgcaccaccttcacgatgagggcgccggccaggttgcccactccgaaggccatgtacagcagcgacatgctgaagctggccatgctcttgggcagctcggtgtacaagaactcgatctccccgatgacgccgaacgcctcggcgagccccacaagcgcgaactgcggc

SEQ ID NO: 78353 - DNA, 570 bp, Zea mays
  Clone ID: LIB3079-032-Q1-K1-A6.R2
gccgcagttcgcgcttgtggggctcgccgaggcgttcggcgtcatcggggagatcgagttcttgtacaccgagctgcccaagagcatggccagcttcagcatgtcgctgctgtacatggccttcggagtgggcaacctggccggcgccctcatcgtgaaggtggtgcaggtggcgagcgggcaaggggtgggaacgggctggctcgtcgacaacttgaacgtcggccgctacgactattactactggctgctcacgggctacggcgtggcgaacttcgtgtacttcgcttggtgctgctggttgtatggcgaggaggggaagaacgtggagtgggaagaggaggacaacacggagcagccctagtcctgtatggctgggactcctgtgagccctgtagggctgaaacaatgaacttctggaggttgaatgttcaatgcatgtggtagtataaaacatctagttaactttactagcctattagttactgttgtttagacttgtcagggtcaccagcagaggaggtttattagtcttcctacaagtcaatgcataacatcgatactgcgcat

SEQ ID NO: 78354 - DNA, 336 bp, Zea mays
  Clone ID: LIB3079-032-Q1-K1-C8.F1
aacttcctgagaaggatgatttcattcagctcaccatcgatacagatatacatgagcagaaactccaaaaaaaaaacaggtcgtaatttacaaaactcaagacacaacaacagtcgccgaagcttaaaacgagaggttgtcctcgacgaggcagccgtcgtcgaagctccacagcggcatgtccgggtccgccgcggcgcggtttggctctgcacggcgtcggcgctgaacaggctgtcaagcgactcgtacgcgccggctccgaaaaaggcgaactggtcgccgaagaggagcgagtcaaaaagcgcgtccgactcggagtcggaggcccggggc

SEQ ID NO: 78355 - DNA, 426 bp, Zea mays
  Clone ID: LIB3079-032-Q1-K1-C8.F2
acttcctgagaaggatgatttcattcagctcaccatcgatacagatatacatgagcagaaactccaaaaaaaaaacaggtcgtaatttacaaaactcaagacacaacaacagtcgccgaagcttaaaacgagaggttgtcctcgacgaggcagccgtcgtcgaagctccacagcggcatgtcctggtccgccgcggcggcggcgttgctctgcacggcgtcggcgctgaacaggctgtccagcgactcgtacgcgccggcgtcgaagaaggcgaactggtcgccgaagaggagcgagtcgaacagcgcgtccgactcggagtcggaggcccggggcgactcctcgtccggggcgctctccggccgcgccttgaagtcaaaggccggccgcggcgcggggggctttgtttaggccgccatcacgccc

SEQ ID NO: 78356 - DNA, 67 bp, Zea mays
  Clone ID: LIB3079-032-Q1-K1-C8.R1
cccaagcgtccggccaaacacacgcgaaaagacggagtcggagtacaggttacagagaggcaaagag

SEQ ID NO: 78357 - DNA, 262 bp, Zea mays
  Clone ID: LIB3079-032-Q1-K1-C8.R2
cccatgcgtccggccaaacacacgcgaaaagaaggagttcgagtacaggttacagagaggcagagagcaaagatgtgtggtggtgcgatcctcgccgagctcatcccgaccacgccggcgcgccgcggcggcgcggcgtggcccgccggcaagtgcaagcggcggaaggcgaacgacttggaggccgcgttccgggagttcgactaggactccgaggaggaggaggaggaccagggggtggtggagagcaagcccgtcttcg

SEQ ID NO: 78358 - DNA, 215 bp, Zea mays
  Clone ID: LIB3079-032-Q1-K1-G11
attttctttatttagagtacataaccttgcatttgcgaaattcataataacaaggtgctactatgaattttgtacactgacaacaaacaaaacattgcgctaagccaagtatgctataaagctgtagatattacatatctgatacccatagattacagggaaatatgatgatatcgatagggaagtgaaaaaaaggtttaagagaaatcgacatg

SEQ ID NO: 78359 - DNA, 57 bp, Zea mays
  Clone ID: LIB3079-034-B7-F2A
attagggtccaacagttattcccaaagttctggattaattggggagggggggggggg

SEQ ID NO: 78360 - DNA, 685 bp, Zea mays
  Clone ID: LIB3079-034-B7-F3A
attcctctgcaagcgctggtccacagtcatatactggaactatgtcaagctggacttttccacgagcttcttttataccaagccctaggtggcaaagtccttcaaattatgcaccaatggttgtacctcatggccttgtccaagtgccgagctggaattcatatcctggtcagctgcagtcacctggggctcaacaaacttatggaagttcacaacaaggcgaagctagtgcaggaaatcagggaatgctatcaccctatagatccagttcatttcctgtgcctcaatatgcgttgcagagagataatgtatttcctgagagacccgatgaaccagaatgccaatattacatgaagacaggagattgtaaatttggtgcagtgtgcaagttccatcatccccgtgtgagatcacagccccctccggattgtgtcttaagtccaatgggtcttccaatacgtccaggtgaagaactttgcaaattctattctcgttatggcatctgcaagttcggcgccaactgtaaatttgatcattcctacaatgacttgcttcaatgggagtttatgcatatgggttctcttggtctgcttctgtcgcacccgcttcaactaatgcacctatgacgcgacatcttcttggatcttcatcaggttctggatatatgtcttaggtgtcttttttt

SEQ ID NO: 78361 - DNA, 204 bp, Zea mays
  Clone ID: LIB3079-034-B7-R1A
acgcccacgcgtccgggatactcatctgcagcatgaagggcgaatatactccgagcgtgcgacacccagagtgtcagtattatctgaagaccggaccatgccagtttggtcctacatgcaaatttaaccatcccagcgaaaacgacggacttgaagggaccgtgaacctaaccacattaggatatacaattctccaggtttgat

SEQ ID NO: 78362 - DNA, 450 bp, Zea mays
  Clone ID: LIB3079-034-B7-R2A
cccacgcgtccgggctattgcctctgccagaatgaagggagaatatcctgagagagtgggacagccagagtgtcagtattatctgaagaccggaacatgcaagtttggtcctacatgcaaatttcaccatcccagggaaaaggccggaattgcagggagggtgcagctaaacacattaggatatccacttctcccggtttgttttttcttgccagttacatgtcctcttctacatatgtctgtttgttttgctgaaaaggagtctactttacttttgtagaatgaaaaggagtgtgcgtattatttaaaaacaggacaatgtaaatatgcaaatacttgtaaattccaccacccagaacttttcaatgtggtgccttcgtcacgtggttcacctatttatacttctgtacattcctctgcaagcgctggtccacaatcatatactggaac

SEQ ID NO: 78363 - DNA, 714 bp, Zea mays
  Clone ID: LIB3079-034-B7-R3A
atggacacgcctggactttggcacgagcttcttttataccaagccctaggtggcaaagtccttcaaattatgcaccaatggttgtacctcatggccttgtccaagtgccgagctggaattcatatcctggtcatctgcagtcacctggggctcaacaaacttatggaagttcacaacaaggcgaagctagtgcaggaaatcagggaatgctatcaccctatagatccagttcatttcctgtgcctcaatatgcgttgcagagagataatgtatttcctgagagacccgatgaaccagaatgccaatattacatgaagacaggagattgtaaatttggtgcagtgtgcaagttccatcatccccgtgtgagatcacagccccctccggattgtgtcttaagtccaatgggtcttccaatacgtccaggtgaagaactttgcaaattctattctcgttatggcatctgcaagttcggcgccaactgtaaatttgatcatcctacaatggctgctccaatgggagtttatgcatatggtttctctgggtctgcttctgtcgcacccgcttcaactaatgcacctatgacgcgacatcttcttggatctccatcaggttctggatatatgtcttaggtgtcttttttttcagttgacctactttgatgtataaaatccacggcatcgactcaggcgctgagaatgtttcttctaactt

SEQ ID NO: 78364 - DNA, 141 bp, Zea mays
  Clone ID: LIB3079-034-Q1-K1-B11
ctcctccggcccatggccgactgcccgcccggcttcttgtgcgtcgatccatctacgggggctttgtacacaccttgttgcactttgatgttactacatgacatgtatttagtatactgcgatttcagacataaattaaat

SEQ ID NO: 78365 - DNA, 67 bp, Zea mays
  Clone ID: LIB3079-034-Q1-K1-D12
cccacgcgtccgaaaaaaaaaaaaaataataaaaaaaaaaaaaaaaaaaaaaaaagggagaaaatat

SEQ ID NO: 78366 - DNA, 531 bp, Zea mays
  Clone ID: LIB3079-034-Q1-K1-F9.F2
aaaaaaaaataaaaaaaaaaaaaaaaaaaaaaaaaaaaaaagggaaaaaaaaaaaaaaaaaaaaaagggggggaaaaaaaaaaaaaaaaaaaaaaaaaaaaaaaaaaaaaaaaaaaaaaaaaaaaaaaaaaaaaaaaaaaaaaaaaaaatcgggaaaaaaaaggggaaaaaaaaaaaaaaggggaaaacacaaaaaaaaatgtaaaaaaaaaaaacaaaaaacgcctaaagtatttaaaaaaaccaagtttaaaaaaaaaaaaaaccaggaggagaaaggaaaaaatctttaaaaaggaaaaaaaaaaaaaaaaaaaaaaaaaaaaaggaaaaaaaaaaaaaaaaggaggggtaaataacattcaaaaaggggaaagggaaaaaaattaaaaaaaaaaaaaatcgtaaaacaaaaaaaaaaaaaacctaaaaaaatagaaatggagaacaagggggtaagtgaaaagtaagattacacaaaaggtgaaaaaaaaaaaaccgagggagggaaaagcttcatatttttaaaag

SEQ ID NO: 78367 - DNA, 609 bp, Zea mays
  unsure at all n locations
  Clone ID: LIB3079-034-Q1-K1-F9.R2
acttgctcttgccttctgttcttcatccgtttcagattttgaatcaaaggttttagtccttaaggtgctgaagaagtgtgtcaagctgccagttctagctcatcatctagtaaaagagtctggcattctgttgtggttattgtctgttatttcagtccgtagcgaagtgtctgacgggtctgaaagctcctgttctagagtaactgagttagcgttggaggtagtcaatggtttgatatcatcaagattgatcacagattggctccaagaaaccgcccttgagcagctctcaacaatatcatcatacctttctgttctaattaacaatgccaaattattgaaaggaaatgttcatttgttgacttcagctctaagtgtgattacatcaacaatgaggttgtctatgaaaaggaagatataccaaccacattttaccttgtccctccatggtgtatttaatctgtgccaaactattggtggtagctcaagaagtacagagcataagcttgtaatggaacttggtatcgatgccattctgatgaatggtcctataccaattttatctgaaatggataagtcaagaatatcaatggnntgttcatgggcaac

SEQ ID NO: 78368 - DNA, 64 bp, Zea mays
  Clone ID: LIB3079-034-Q1-K1-H8
cccacgcgtccgaaaaaaaaaaaaaatttaaaaaaaaaaaaaaaaaaaaaaagggaaagaaaaa

SEQ ID NO: 78369 - DNA, 242 bp, Zea mays
  Clone ID: LIB3079-035-Q1-K1-D2.F1
caaggaaacagaggacaaattataaaaataaataatgcttgtgacaaattgaaagagtagctttaccggctcctacttctaaaagaaaaggggaaaacagttcttcagacataaaagataaaaaaagtacatacaataaagtctcttttttttttctaaagacaattcaatagacaggtaggattgtacaaatgagttttttatactcaagaggtcgtgtaaaagatactctttagaatgaa

SEQ ID NO: 78370 - DNA, 613 bp, Zea mays
  Clone ID: LIB3079-035-Q1-K1-D2.F2
caaggaaacagaggacaaattataaaaataaataatgcttgtgacaaattgaaagagtagctttaccggctcctacttctaaaagaaaaggggaaaacagttcttcagacataaaagataaaaaaagtacatacaataaagtctcttttttttttctaaagacaattcaatagacaggtaggattgtacaaatgagttttttatactcaagaagtcgtgtaaaagatactctttgaatgaagagacggcctcctgagtatgtttctgacacgtcctcttgaaaatttctgaagagacagcctccctgttgcttgcgatgttgcagatacatatagtccaacccttttacggccctgatcctggatttctgattagcatcgctgaatgatgcatatgatggcaatgctcgctgatgttgtgtgcttactcaatgtggatagatctcatcaataggaatcgacctcacatatgatgcacggccatttccaacagaagggatcgttctcatgacttgttcctatcgaatatggttgaagctgttgaacatcccagtgtgggaagccttggctgcaggcttggccacttcagggtctccaaatacgttccagaaccg

SEQ ID NO: 78371 - DNA, 135 bp, Zea mays
  Clone ID: LIB3079-035-Q1-K1-D2.R1
atcctcaccactggcagtatggattggcagatcgtgaacaacgacgtgagaattaggaaccatgttgtacacacatacgaggggcacagccaggaggtgtgtgggctcaagtggtctggatcagggcagcagctg

SEQ ID NO: 78372 - DNA, 648 bp, Zea mays
  unsure at all n locations
  Clone ID: LIB3079-035-Q1-K1-D2.R2
atcctcaccactggcagtatggatggcaagatcgtgaacaacgacgtgagaattaggaaccatgttgtacagacatacgaggggcacagccaggaggtgtgtgggctcaagtggtctggatcagggcagcagctggctagtgggggtaatgacaaccttctgcacatttgggatgtgtcgatggcatcccccatgtcaaccgctggccgcaaccagtggctgcacaggctcgaggaccacatgtccgctgtgaaggcactcgcgtggtgtcctttccagagcaacttgctggcaactggtggtggcggcagtgatagatgcatcaagttctggaacacacacactggagcatgtctgaactctgttaacactggatcacaggtctgtgcccttctatggaacaaaaatgagagagagctgctgagctcacacggattcacacagaaccaactaaccttgtggaagtacccatcaatggtaaagatggctgaactcagtggccatacctntcgtgtccttttcatggctcagagccctgatggttgcacagtagcatcagccgctgcggatgagacccttcggttctggaacgtatttggagaccctgaagtggccaagcctgcagccaaggcttcccacactgggatg

SEQ ID NO: 78373 - DNA, 453 bp, Zea mays
  unsure at all n locations
  Clone ID: LIB3079-035-Q1-K1-D5-F2A
cgcgcatcgaatcgccaccagtgccgattctgctgacccctcgccatcgccggcgggcgaatcgacaccatggccgccgcacgccggggccgcgccgacggtgccaacggcgtcgtccgtccccgcccccgcgaccgtgtcgggggcgtcagcggaagcatggcggggcgcgtggccgtcctcgccttctgtgtcgccgggatctggtccgcctacatctaccagggcgtcctccaggagactctatccacgaagcggttcgggccggaggcgcggcggttcgagcaccttgcgttcctcaacttcgcgcagaatgtcgtatgcttcgtctggtccttcctaatgactaanttgtggtcgggcgggagcgggagcagcttctacggccgtgcgccgntattgaagtactggggcgtcagcgtaactaataccatcgggcccgccatggggatc

SEQ ID NO: 78374 - DNA, 263 bp, Zea mays
  Clone ID: LIB3079-035-Q1-K1-D5-R2A
agctcaaaatttcagcagactactttaacattatccaggtcaaccgcacaacagatctgtccaattgaagttacaaatgggaacaggttcaagagtcaacaatcgggcttactcattgggggctctgcccttctttctcttccattggagaaatatttggacagaagggcctaaaaagaccatcgcaacactaccccattgctttgaaaataatggattgccgttgtttacaaatgaaacgacgatgctcatgaatttacggg

SEQ ID NO: 78375 - DNA, 494 bp, Zea mays
  unsure at all n locations
  Clone ID: LIB3079-035-Q1-K1-D9.F1
gaagtacagaacaacactattatgattaacaataccttcgaaactgggaccaaacggaacactcantggttaattggtgagttattgtggatttcgatgtcaagggagatcgagacaaccagctcttattcagcgacgcctgcaaataaaatgttcccagcgatcacgaaacccgcagtgcctaatacatgtccatgtgtatggccccatttggacccagcagctcataatcctgcggcggcggtgtagatccggaggcggaggtcggcggcatggatcccatcgccgtctggatgagctccatggcccccgcgcaatgcgtggctgctgctactcggttcatctctgtggcgctcagagttccaccgacgaccatggatgcaggctcttgatgagcttgcagtcgcaagaaaccgttgccgaccgaagcatcgtcgtctgcggctgtggcggaaaagtatccgacgatgctgtctcggataggcggcggcggc

SEQ ID NO: 78376 - DNA, 567 bp, Zea mays
  Clone ID: LIB3079-035-Q1-K1-D9.F2
gaagtacagaacaacactattatgattaacaataccttcgaaactgggaccaaacggaacactcatggttaattgtgagttatttggatttcatgtcaagggagatcgagacaaccagccttattcagcgacgcctgcaaataaaatgttcccagcgatcacgaaacccgcagtgcctaatacatgtccatgtgtatggccccatttggacccagcagctcataatcctgcggcggcggtgtagatccggaggcggaggtcggcggcatggatcccatcgccgtctggatgagctccatggcccccgcgcaatgcgtggctgctgctactcggttcatctctgtggcgctcagagttccaccgacgaccatggatgcaggctcttgatgagcttgcagtcgcaagaaaccgttgccgaccgaagcatcgtcgtctgcggctgtggcggagaagtagccgacgatgctgtctcggataggcggcggcggcactggagcgtcggagctgggggtcggcgccgagatgggcatggacgacggcactgatgagctcatctctatcacccgc

SEQ ID NO: 78377 - DNA, 269 bp, Zea mays
  unsure at all n locations
  Clone ID: LIB3079-035-Q1-K1-D9.R1
cttcaagcagctaacataattaactcatgggtgcatagagatatgccgccgacgacccatcatatctatggttacttattattgggcatggagcacgtcatctcaatggaggagatcctcgggcccttctgggagctgctaacaccgncagcgcgagagccagagccagagcgagagcagcctccggtaaccgccatcgttgtcggcagtgtcatagacattgctgctgatggtcacggtcatggttgctgctaattgtggatcagcag

SEQ ID NO: 78378 - DNA, 631 bp, Zea mays
  unsure at all n locations
  Clone ID: LIB3079-035-Q1-K1-D9.R2
cttcaagcagctaacataattaactcatgggtgcatagagatatgccgccgacgacccatcatatctatggttacttattattgggcatggagcacgtcatctcaatggaggagatcctcgggcccttctgggagctgctaccaccgccagcgccagagccagagccagagcgagagcagcctccggtaaccggcatcgtcgtcggcagtgtcatagacgttgctgctgctggtcacggtcatggtggcggcgacatgatggatcagcagcacgccacagagtggacctttgagaggttactggaagaggaggctctgacgacaagcacaccgccgccggtggtggtggtgccgaactcttgttgctcaggcgccctaaatgttgaccggccgccggtgatggaagaggcggtaatgatggcgcctgcggcggtgagtagtgccgtagtaggggaccccatggagtacaatgccatactgaggaggaagctggaggaggacctcgaggccttcaaaatgtggagggcggcctncagtgttgtgacctcagatcaacgttctcaaggctcaaacaatcacactggaggtagcagcatcaggaataatccagtgcagaacaagctgatgaacg

SEQ ID NO: 78379 - DNA, 107 bp, Zea mays
  Clone ID: LIB3079-035-Q1-K1-G11
aaaaaaaaaaaaaaaaaaaaaaaaaaaaaattaaaaaaaaaaaaaaaaaaaaaaaaaaaaagggaaaaaaaaaaaaaaaaaaaaaaaaaaaaaaaaaaaaaaaaaaa

SEQ ID NO: 78380 - DNA, 193 bp, Zea mays
  Clone ID: LIB3079-036-Q1-K1-C5
cctttttcaagcaacgcgagccatctattttttttgtctagctatgttagtgatgggttgtgagagacctcaatgttaccaccgtatctttgtctttgttggatggagagatttaagcaccttaccacacctttgttctttgttggatggatagttttaagcatcacctgtttgaagttgaaaaccctaactt

SEQ ID NO: 78381 - DNA, 430 bp, Zea mays
  Clone ID: LIB3079-036-Q1-K1-C9
acggaaagagtcaaagcccgtctcgaatagcttactctcattctgatctctttcaggtttcgtattctatatatactagagcacaatacttgcctgatgtctaacaatatgcattgccatactcatttcctcatagattcttctggattattttttgacaatagataatcattttgatgaaagtccgtagctattctgtaatctaattcagaaccgatcaataattcattttttcaaagataaaaacaattacataacatatgggcaaagattgtcataatatgttcaaacatgaaccatgcaatatatacatccatactttacaactgtagtatcagtagaatgcacagacataaatattatagtagtaaaacacattcttagcaagttattgccattatattaacatcattcacagttacacaccact

SEQ ID NO: 78382 - DNA, 558 bp, Zea mays
  Clone ID: LIB3079-036-Q1-K1-D4.R2
agaagcccggcggcgaagaagcccgcagaggaggagcccgcggccccggcggagaaggcccccgctgggaagaagccgaaggcggagaagcggctcccggcgggaaaatccgccggcaaggaaggcggtgttgacaaggaggggcggaagaaggccaagaagagcgtggagacgtacaagatctacatcttcaaggtgctgaagcaggtgcacccggacatcggcatctcctccaaggccatgtccatcatgaactccttcatcaacgacatcttcgagaagctcgccggcgaggcggccaagctcgcccgctacaacaagaagcccaccatcacctcccgggagatccagacctccgtccgcctcgttctacccggcgagctcgccaagcacgccgtctcggagggcaccaaggccgtcaccaagttcacctcgtcctaagctccttttctagtaggtccttaagcgccgtggcgccttttgactgtatggaatgtttgtcatctgaaaggtgatctgagcagtgcaatatataattcttggcatactatttctcgc

SEQ ID NO: 78383 - DNA, 482 bp, Zea mays
  Clone ID: LIB3079-037-D6-F1A
aaaatgaaaatctgcacggactggtatgggttatggaagagtcgtcagacatcagactaggcatagacaagtacaaatatcacgagacattcatatcttttactacaacggtccaacgccaaagatacagaagcatatggacgccctgctatgtcagcacggagtcctgaattctctttcttatctccctggtattgctcaagtgctcatcaatgagtggtattgaaatgaaatcatctacgggtagaaagttcaagcgatttcttggccatgtcatcggtttggcatgatgtcgatgctgccttctagatcacacgagcgctcaggacaatccagtttaccccaacgtgcagttactctttggcagggaaatattggcttcccaaggcttcgattaaccacgttatggacataacataaccactgggagaaatcagcctgagatcctgcctgcacaggatttgctttcaaaacttccttga

SEQ ID NO: 78384 - DNA, 465 bp, Zea mays
  Clone ID: LIB3079-037-F7-F1A
cataagtccatatttcaactaccaaaaataaaacgatgaagtacaagctgcacgttccctatgtattttagttaaaacagggacttgtaacatcacgataacctatactggcagtttagtcacagtcagcaaccaaggaagaaacatatgccagcctctgtttgttggcacaacctatccaccggaagtatgcgattgggactttggactatcatcacaaaaataccacttaaaatgcggctctcattgcaccccttgtcgcatcacgcttcatctctgcagcctttccacttccacggaagtacatgtacacttgctggatgacccagatgctgagcaacgattccagacaaaacaatccaaatccaacaaagtagaatatctgcagaacactcgtatggattactcagttactaaacaaatcagagaattatatttcgcatcaaggatactagatgaagataa

SEQ ID NO: 78385 - DNA, 452 bp, Zea mays
  Clone ID: LIB3079-037-F7-R1A
ggaattttgccagcaattgatcttatcagcgtgaatgctttggttggggtaagctgagcacctatttgtttgataaatgagatatataggtttgaaagtattgagaaattatcttcatctagtatccttgatgcgaaatataattctctgatttgtttagtaactgagtaatccatacgagtgttctgcagatatgctagtttgttggatttggattgtattgtctggaatcgttgctcagcatctgggtcatccagcaagtgtacatgtacttccgtggaagtggaaaggctgcagagatgaagcgtgatgcgacaaggggtgcaatgagagccgcattttaagtggtatttttgtgatgatagggcaaagtcccaatcgcatacttccggtggataggttgtgccaacaaacagaggctggcatatgtttcttccttggttgctgactgt

SEQ ID NO: 78386 - DNA, 242 bp, Zea mays
  Clone ID: LIB3079-037-Q1-K1-A12
gctcgttgtgcttggggaggagaaaacgaaaagactataaagggctgggtctgacgaagattgcgttcacggcagtgtgagtccgcgagctggcgcgcagcgacccgtgcaaacaagctccactgtggccttctgcgctcgaccgctgtctcagtcggacacggcactgctatcacacaacagcctctcgccagtgtcgggcaagacagtgtctgctgtcagggtctgacacctggtcttga

SEQ ID NO: 78387 - DNA, 70 bp, Zea mays
  Clone ID: LIB3079-037-Q1-K1-A3
aaaaaaaaaaaaaaaaaaaaaaaaaaaaaaataaaataaaaaaaaaaaaaaaaaaaaaaaagggaaggaa

SEQ ID NO: 78388 - DNA, 70 bp, Zea mays
  Clone ID: LIB3079-037-Q1-K1-C4
attaaaaacaaacaagcaatatatattgtgtaaaaaaaaaaaataccaaaaaaaaaaaacggaaagaaat

SEQ ID NO: 78389 - DNA, 387 bp, Zea mays
  Clone ID: LIB3079-037-Q1-K1-G2
acgagacgctgagccgtgacgtgtaccgtcttttacataatattgactttttcagaatgttgggctgcatcatactactattggcccctacttcagcacaatgataacacatatgaccgtttatgtatacctctacggacgcctgtatcttgtcctaaatggccttgatgaagcattagccactgtaaagaggtttatacacaacaagcctctccacgatgatctagctccacagtcttttgcgcaccttatatacttgatctcactatctatgatgatgtaaattggactaaagacagacttcaacatatatgcttccatatatctctcttgctccctttacttctatgaaaccattacacaaacataactgtttctataaccttt

SEQ ID NO: 78390 - DNA, 89 bp, Zea mays
  Clone ID: LIB3079-038-Q1-K1-H9
aaaaaaaaaaaaaaaaaaaaaaaaatttaaaaaaaaaaaaaaaaaaaaaaaaaaagaggaaaaaaaaaaaaaaaaaaaagaaaaaaaaa

SEQ ID NO: 78391 - DNA, 479 bp, Zea mays
  Clone ID: LIB3079-039-A3-F1A
aatataacttggtttttattaaccagccggagatacatctcatttcaacatcatgtttggacgatgattccataagcgatggcaggctggcagctacactcttttaggccatgacctgcctcacaaaacaagattaatacttgttagcttattacaaggacactccactgtagtctaaggactgtcaagtgatagaacgagtattaactacctgatggtgtggatgtgaaggggcgcatgcatctctaaatcctagaatcttccttacactgtatttggccttgtcagcaagtgagagtatggaggcaatgcaaagcatgttggttcctggcacctttctcaccgccacgcagcacgcaccgtgccgggatggagtatagtcaggtgttgagttcagtggatcacactcgcgcaggatctctctcttctgatcattgttacacggtaaacggccaagcactggttggtagagaactagc

SEQ ID NO: 78392 - DNA, 459 bp, Zea mays
  Clone ID: LIB3079-039-A3-R1A
cccacgcgtccgcccacgcgtccggtttgagctgttgtaccttcacccaatccacatatagcactacaaaatggtcactgggaaagtagcagtcgtcctcctagcctgctggacgctagttctctaccaaccagtgcttggccgtttaccgtgtaacaatgatcagaagagagagatcctgcgcgagtgtgatccactgaactcaacacctgactatactccatcccggcacggtgcgtgctgcgtggcggtgagaaaggtgccaggaaccaacatgctttgcattgcctccatactctcacttgctgacaaggccaaatacagtgtaaggaagattctaggatttagagatgcatgcgccccttcacatacacaccatcaggtagttaatactcgttctatcacttgacagtccttagactacagtggagtgtccttgtaataagctaacaagtatta

SEQ ID NO: 78393 - DNA, 451 bp, Zea mays
  Clone ID: LIB3079-039-C9-F1A
agaggccagaatgctttattccttaacaaaaaaaagaaatcagtgtctggcatgtctagactgaaatgtgtggttcctgacagtgacttgatagacaaatcttgtacagtgctcagcagagattctgcacttctgtgtccagcagaacccagacgacaagggctgcagtgaaatcgagattaaatctgctacagcttggacagtctgacttgggcgatgagctctctcctcaaaatcttccccgcagcagatttcggtacgctgcccacgaacgttaccttcctcagcctcttgtagtgcgcgacctgtttctcgataaatttctggacatcagcttcggccagtgaactcttcggtgatagtacaacgtaggcgataggaacttcccccgcttcagcatcaggatacgggataacagcggcatcaaggatttctggatgagacaaaagca

SEQ ID NO: 78394 - DNA, 182 bp, Zea mays
  Clone ID: LIB3079-039-G2-F3A
gcccagacgtccagtagtgatatactgacatccatagcgagaagccaatttctgtgtacagatttgtttagcaagttatcatatactaggatataactttttgagacacaagggacaaaatctgtggaggtaagggcatctcactttttttgatgaaacattagcaggagctctgccatatc

SEQ ID NO: 78395 - DNA, 221 bp, Zea mays
  Clone ID: LIB3079-039-G2-R3A
tgacctgacgaaagtgcgtccagtcctggaagggatccagcgatcttgcggaacaggggcttgacgttgaacccagcttttgcactggtctccatgaacatagcaccatgctcctgtgctttggcttctccttcgtcggtggacactttcctcttgtcgacaaggtcagttttatttccaacgaggaagatgagcacgtctccacctctttgcgtgtttac

SEQ ID NO: 78396 - DNA, 85 bp, Zea mays
  Clone ID: LIB3079-039-Q1-K1-A6
aaaaaaaaaaaaaaaaaaaaaaaaaaataaaaaaaaaaaaaaaaaaaaaaaaaaaaaaaggaaaaaaaaaaaaaaaaaaaaaaaa

SEQ ID NO: 78397 - DNA, 482 bp, Zea mays
  Clone ID: LIB3079-040-C4-F1A
ctcttcttttttttcttcccaggaaaagggcctcaaggcattcacatttcacaatgcacgacatcatagtacataccaaggccgaggcccgaataccaatgctgtgctcataaatgagactaccctgtagaacacacactgctccgatatgatctgaatcgccacggcgtgatctgactactctgcttgcgtacacaagcctctgctatgaagacttcaggctttcgaggaattcaggcaccacctgaccgcagtctgcaagaagctgcgccacaggcctcgcaacagaagcatcagtgttacagaatatgctctgcacttcgcccccaatcacatccagagcagccccagtgaggatctcaatgtattcgccgcctgaaggaggcagatccaccaccagcacggtttcgcatgcctctacatctgtcactgacatgttctcccggtcttccacaatgacatccatcagccccagactgctg

SEQ ID NO: 78398 - DNA, 458 bp, Zea mays
  Clone ID: LIB3079-040-C4-R1A
ggccgtccaagttcctggtggtctgtctcaacgctatccgggatgcggtggcgcccgaggaaggcggtggcagcatccacggcgccggcgactggggcgtggagctctggcggtgctgctccgcccaggcgccgtccgacgtgctcgacgctagcggcgcgtgcgccacgcgtggcgcagaccgcgtggctcgtctccaccgcctgcgacatcgtcctaggaaagagaggcatgggatggtcgtgtcttgccccttcctgctgtacctcgtctcgtcgcaggataaggccgcgcagctgcgatcgatatgcaaacccctgaagcctcttgggattcattcagtgagcttgcatcctggcgcatccattgaacaccagatctctggactgaaaacttgtgagccggagtttcttattgctacccccgagaggcttcttgaacttgtttcgttaaaggcg

SEQ ID NO: 78399 - DNA, 120 bp, Zea mays
  Clone ID: LIB3079-040-Q1-K1-B10
attagagtgaatatcatgcacgtgttgccccatctactccagtatttattactgaaccttgaaaaaaatcccagtccatcgttcatttgcaaaaaaagatataaaaactaaaaataaaat

SEQ ID NO: 78400 - DNA, 118 bp, Zea mays
  Clone ID: LIB3079-040-Q1-K1-D11
aaaaaaaaaaaaaaaaaaaaaaaataaataaaaaaaaaaaaaaaaaaaaaaaaaaagaagaaagataaaaaaaaaaaaaaaaaaaaaaaaaaaaataaaaaaaaaaaaaaaaaaaaaa

SEQ ID NO: 78401 - DNA, 84 bp, Zea mays
  Clone ID: LIB3079-040-Q1-K1-F11
ggacgaccgcactcgtacgaaaaaaacaaaaaaaaaaaaaaaatataaaaaaaaaaaaaaaaaaaaaaaaaaaaaggagaaaaa

SEQ ID NO: 78402 - DNA, 646 bp, Zea mays
  unsure at all n locations
  Clone ID: LIB3079-040-Q1-K1-H8.R2
aatcgttgagaaatgctcgaactatgcgatcttgagaagcagcattatatatgggccacaaacaatctctcctgtggcaaaatcccttccgattcagtggatggatggtgttctttcacaaggccaacaggttgagttcttcagtgatgaattccggtgccctgtctatgtcaaagatatggtggacgtaattttgtcactaacaaagacttggttcccagatgatggcaaaaaagtccaggtcctcctgaatgtcggtggtccagatagggtatcaagactgcagatggctgagtctgttgctgttgtccgtggatataaccccagtataatcaaatctgtgtctgcatcatcggttaatcgcggagtagcttctccaccagacatatccatggacatcaccaagctaacccagatccttggtatcaagccaatatcatttcaagatggagtcagaagtacacttgatgcagaagacagtacatgacgcttcctcactggtttgcttgagttcttaagggggagttgtttgcattcaaatgtagtagtgtgacataaagaatcacatttgatttgcaaaatttcagtatcggtaaatttctgttgggtctatgtgaaatatgnaagttttgtacccactaaacac

SEQ ID NO: 78403 - DNA, 69 bp, Zea mays
  Clone ID: LIB3079-041-Q1-K1-A6
aaaaaaaaaaaaaaaaaaaaaaaaaattaaaaaaaaaaaaaaaaaaaaaaaaaaaaggggaataaaaaa

SEQ ID NO: 78404 - DNA, 504 bp, Zea mays
  unsure at all n locations
  Clone ID: LIB3079-041-Q1-K1-B8.F2
aaaaaaaggaaagattcctcaggcgccactatgtcatgcatgggtgatatatttattcaagatcttcaggccccgttcatgaccggcttcttcatctcccacgcggtgagacgggacaccttgacgtgcgccctcccggtgttgaacacgtagaggcgagcgtccttgccgatggccagcgacgggtagaccctggagaggatgcaggtcttgcccccggctccgaagctctcaacgaccgaccggtcgatcaggcttctcagggatatcttgccgntcgagatgtccgtgtcgacaaatcctgcaaatgtcgggcggtacaggttcgggttcagggacgacttggtagggtcggtgcacatgagcaccacgggcttgtcgctgccggcggcgggcttgaacaccctgaagaacacggcggttctctccttgcggttggcggaggccagcacccacagcccgaacgggcccacgccgtccttaacgttcgggcgctttacgccg

SEQ ID NO: 78405 - DNA, 468 bp, Zea mays
  Clone ID: LIB3079-041-Q1-K1-B8.R2
gctgcatttgcctatcgaggaggccgaggcgctgagagaaaagtcggtcactctcaagaacaggttaatcaaggcaggacatcacgtcgaggtgaccgggatacaaacggcacaggctgacgtggaggtgagcttcgaggtgtcgccggcggccctggccggtgccgagacgctggacgcgggcgctggcctacgacgcggagaagctgtgcggcgtgaagcgcgcggacgtgaggggcggcgtggggccgttcgggctgtgggtgctggcctccgccaaccgcaaggagagaaccgccgtgttcttcagggtgttcaagcccgccgccggcagcgacaagcccgtggttgctcatgtgcaccgaccctaccaagtcgtccctgaacccgaacctgtaccgcccgacatttgcaggatttgttgacacggacatttcgaacggaaagatatccctgagaagcctgatc

SEQ ID NO: 78406 - DNA, 468 bp, Zea mays
  unsure at all n locations
  Clone ID: LIB3079-041-Q1-K1-C3-F2A
gcgcccacgcgtccgggctcaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcangaccgtcacagccatggacgtcgtctacgcgctcaagcgccagggccgcaccctctacggcttcggcggctaggctatgccggtcgcgctcgcgcctcgctgtcgtcgctgcgggtcttgtttctgcaattcgcaaggtgtggcttgaccggga

SEQ ID NO: 78407 - DNA, 308 bp, Zea mays
  Clone ID: LIB3079-041-Q1-K1-C3-R2A
cccaataagctagttcgtcattgaaataaaatgaaacaggggtaatggattacctagtacagaaatacattaagcttattggacagagatggaatgcccgcaagacacatcatgactaagttaactacatttgtaacacacccagggaccacgggtgttgatttgtgaagaaacggaacatgtttgaacaaacagcaagtcacaattggcattttttcagacacgcacaacatgcttgatctagggctacattaaccagcattttccccgtcaagccacaccttgcgaattggaaaaacaagaacccc

SEQ ID NO: 78408 - DNA, 79 bp, Zea mays
  Clone ID: LIB3079-041-Q1-K1-C9
cagcacccctgtttcaaaaaaaaaaaattaaaaaaaaaaaaaaagccaaaacacaaaaagagaaaaaaaaaaacaaaaa

SEQ ID NO: 78409 - DNA, 136 bp, Zea mays
  Clone ID: LIB3079-041-Q1-K1-F10.F2
aaggaatgaagaaaacttggattatataaggcataggatcatgaaccaataaggcaccggaccatatttttttttacaaccaggtggttgggatcatttttttttctgcttagatgaacggctctgtctccctgct

SEQ ID NO: 78410 - DNA, 78 bp, Zea mays
  Clone ID: LIB3079-041-Q1-K1-G8
aaaaaaaaaaaaaaaaaaaaaaaaaatataaaaaaaaaaaaaaaaaaaaaaaaaaaaggaaaaaaaaaaaaaaaaaaa

SEQ ID NO: 78411 - DNA, 106 bp, Zea mays
  Clone ID: LIB3079-041-Q1-K1-H1.F2
ctgtttttttttttttattatttttttttttttgttttttttttttaataacttttttagtaagctttattattagattatgaaccttcaaactctacaataggta

SEQ ID NO: 78412 - DNA, 321 bp, Zea mays
  Clone ID: LIB3079-041-Q1-K1-H9
gatgaagagggtgacgaccagtgaagaggccacgctgctctactgctaatggccgaacttgataatattatttcaataagtttgttttgcttgcctggtgtccgtgtttaaaactgttaattgtcgtgtggcgcagcatactcttctgttgctgcatgtgtcgtcgtcagtttggttgtctgctggatgtcacagtttattatggattgctactatacaagtatttgtttcggatgtgttgtataacctttcgggatgtaacattttaaaaaaaactcacttagcatgcacgcaacacacggaaaaagatcatacaaaaag

SEQ ID NO: 78413 - DNA, 384 bp, Zea mays
  Clone ID: LIB3079-042-Q1-K1-A1
gctgccatggcactcacatgtctccggaggagttatgcggcatgcagtgcagatgctccggcccaagataatagtgcaaccctgccagcattccctgctggtaaccaagccacgtctgcagaaaattaggttagcggttcagagaatgcttgactaataatccttgcccctctagaggctatatcagccatgcactgtaatactcagggggaatgtatggtgaactttatatcatgcaagtttagacatttgtattttgagctttgtttgaggataaaatctgtgtatttttagcgctatgtaacacatggactgccaattgctgtggttggattttgatctataaaaaaaataaaatttagataaaaaatataaaaaaataaa

SEQ ID NO: 78414 - DNA, 476 bp, Zea mays
  unsure at all n locations
  Clone ID: LIB3079-042-Q1-K1-C4.F1
gatgaccgttgatgtattttactgtttttattttatgatcacgggaaacagatgggaatatggaacagttcaaactctggtagggatgaatcgacccaatatacacacgtattaacatgataccaccatacttactcgtatcacagtcgctgaattccaatgctgcgatgcatgtgtagcatgcatctagagctctcccagcctcttggcgcactcgacgctgcagtccagcgtctcctccactccgtacttgaatctgaaccccaagtcctccagcttgctggtgttgggctgaatcctgacaccttctccggtcacctgagtcagctgtatcttgaggtcggggtgctttgcggcaaagtggtcgaccatgtcacgcatgttaggggtaccnggcggcgcagaggaagcggccggccatggactcctgctccatgcagaagacgtggggctcgcagacgtcctccacgtgcacc

SEQ ID NO: 78415 - DNA, 564 bp, Zea mays
  Clone ID: LIB3079-042-Q1-K1-C4.F2
gatgaccgttgatgtattttactgtttttattttatgatcacgggaaacagatgggaatatggaacagttcaaactctggtgggatgaatcgacccaatatacacacgtattaacatgataccaccatacttactcgtatcacagtcgctgaattccaatgctgcgcatgcatgtgtagcatgcatctagagctctcccagcctcttggcgcactcgacgctgcagtccagcgtctcctccactccgtacttgaatctgaaccccaagtcctccagcttgctggtgttgggctgaatcctgacaccttctccggtcacctgagtcagctgtatcttgaggtcggggtgctttgcggcaaagtggtcgaccatgtcacgcatgttggggtacccggcggcgcaaaggaagcggccggccatggactcctgctccatgcagaagacgtgggcctcgcagacgtcctccacgtgcaccagcggcacggagcccagcagcgcctgcaagaagaggaggggcgttgtgactgaccgcctgccccgtcagcggcgcgacgatcgcggcgt

SEQ ID NO: 78416 - DNA, 581 bp, Zea mays
  Clone ID: LIB3079-042-Q1-K1-C4.R1
ggagaagagctagaggggatgggtggcggcacggtggtgtgtgtcaccggcggcacggctacctcgggagctggctcgtcaggaagctcctcggcagagctgcgtcgtccacgccaccctgcggacctcgcggacgagaagaagacggggctgctccgggcgctccccggcgcggcggacggctgcggctgttcgaggcggacatgtacgacgccgacaccttcgagcccgccatcgccggctgccacttcgtcttcctcgtcgccacgccccttgacgcacgaccccaccagcaccaagtacaagaacacgacggaggcggcggtggacgcggcgcgcatcatcctccggcagtgcgcgctgtccggcacgtgaagcgcgtcatccacacggcctcggtcacggccgcgtcgccgctcaaggaggacggcagcgggtacaaggacttcgccgacgagtccaattggacgccgctcaacctctcctacgaattcaccaacgcttacctggacgactacgtgcggtccaaaaagctgtcggagaaggagctactgagctactcctctttctcatcctctcct

SEQ ID NO: 78417 - DNA, 665 bp, Zea mays
  unsure at all n locations
  Clone ID: LIB3079-042-Q1-K1-C4.R2
ggagaagagctagaggggatgggtggcggcacggtggtgtgtgtcaccggcggcagcggctacctcgggagctggctcgtcaggaagctcctcggcagaggctgcgtcgtccacgccaccctgcggagcctcgcggacgagaagaagacggggctgctccgggcgctccccggcgcggcggagcggctgcggctgttcgaggcggacatgtacgacgccgacaccttcgagcccgccatcgccggctgccacttcgtcttcctcgtcgccacgcccctgacgcacgaccccaccagcaccaagtacaagaacacgacggaggcggcggtggacgcggcgcgcatcatcctccggcagtgcgcgctgtccggcacggtgaagcgcgtcatccacacggcctcggtcacggccgcgtcgccgctcaaggaggacggcagcgggtacaaggacttcgccgacgagtccaattggacgccgctcaacctctcctacgaattcaccaacgcttacctggacgactacgtgcggtccaagacgctgtcggagaaggagctactgagctactcctctttctcatcctcctcctncttctnctcctnctcaaggaagacgaccggccccaggcgttggaggtggtcaccctagcgtgcgggctcgtcggcggc

SEQ ID NO: 78418 - DNA, 119 bp, Zea mays
  Clone ID: LIB3079-042-Q1-K1-D7
accacgcgtgcgcccacgcgtccgaaaataaaaaaaaaaaatggaaccggaactgtgcgacaaagacatacacgaaaatcagaagacaatatactagaacagaaatgtacaagctgaaa

SEQ ID NO: 78419 - DNA, 109 bp, Zea mays
  Clone ID: LIB3079-042-Q1-K1-H2
aaaaaaaaaaaaaaaaaaaaaaaaaaaattaaaaaaaattaaaaaaaaaaaaaaaaagggaaaaaaagaaaaaaaaaaaaaaaaaaaaaaaaaaaaaaaaaaaaaaaaa

SEQ ID NO: 78420 - DNA, 247 bp, Zea mays
  Clone ID: LIB3079-042-Q1-K2-G11
cgcgactgcgttgctcgtgaagttttcaacattgagagtgatcaaatccttagctgcttgcttttgtctctctattttctccttgtgtatttttaagcgtttatccatgaacaaagtatcggtactagggtactactaaaccaaggtatttaggctgtttggctcaggtttaaaaaaaagctggaagccatacaacgcccgatgctagccaccgagctgaacctcggctaccaactggcgccaaaaa

SEQ ID NO: 78421 - DNA, 65 bp, Zea mays; identical to SEQ ID NO: 5343
  Clone ID: LIB3079-043-Q1-K1-E9

SEQ ID NO: 78422 - DNA, 172 bp, Zea mays
  Clone ID: LIB3079-043-Q1-K2-A12.F1
acactgaactactgataccttagctaagacactagctacgtaaatctagcaccttcacagcatcagatctacattcacggcatagtataccatccctgcagcgtcacattcacatctacagtatgagcatgagggcagggatgcaaggctttcttgagaacaactggacaga

SEQ ID NO: 78423 - DNA, 513 bp, Zea mays
  Clone ID: LIB3079-043-Q1-K2-A12.F2
gacttgattctgaattactgttccgtttgccaagacactagattcgtacatttagcacctcaagagctgcggattaacattaacggaatagtatacctttcctgcagtgtaacattaacatttacagtacggacaaagggctggacggctaggtttttttgagaacaaaccggacagattgcgcggcataatactgccctgtcctggtcctgtcctgtcgcccactataataagcttgcttccgtggcggaaaggacaggcagctcggcccaccagagcggagacaggctaggcttcgcatcgaccggacagatacccaccgcctgccttagcctagcggggacctgacttatgctaggccttggcttcggctcggtttgcatgcaatcccggatcacctcaccgatgaccggtccgttagcttgcctgtggtgtggacccaacgcaggatcaagaaacgagactacgctacggtccgagctgggtacgcgctccaccacagccgaggtcatc

SEQ ID NO: 78424 - DNA, 300 bp, Zea mays
  unsure at all n locations
  Clone ID: LIB3079-043-Q1-K2-A12.R1
cccacgcgatccgggngaagcttccgactccataccccgcacacgagcgctccctgcagatgacctcggctctggtggagcgcgtaaccaacgacgaccggagcgtacgctcgttgcttgatccaacgctgggtggagaccacaggggagacgagctagcggtcatcggcgagggggatcctttgcctgcatgcagagcgacccgtaggcgaaggccgatgcattagaggaggtcgccgccacgtggaggggaggccgtgggtatctcgccggtcgctgcgacgccgagtgctgtctccg

SEQ ID NO: 78425 - DNA, 602 bp, Zea mays
  unsure at all n locations
  Clone ID: LIB3079-043-Q1-K2-A12.R2
cccacgcgtccgcgggaagcttccgactccataccccgcacacgagcgctccctgcagatgacctcggctctggtggagcgcgtaaccaacgacgaccggagcgtagcctcgttgcttgatccaacgctgggtggagaccacagggaagacgagctagcggtcatcggcgaggtgatccgggcctgcatgcagagcgacccgaggcgaaggccgagcatgagggaggtcgccgccaggctgagggaggccgtgggtatctcgccggtcgctgcgacgccgaggctgtctccgctctggtgggccgagctggaggtcctttccgccgcggaagcaagctaataatagtgggcgagaggacaggacaggaacagggcaggatgatgtcgcgcaatctgaccagtttgttctcaagaaaaaaaagccttgcagccctttgtgcatgctgtaaatgtgaatgtgaagctgcagggaaggaatagtaatccgtgaatgtaaatctgaaactctgaaggtgctagatgtacgtagctagtgtcttggcaaggtatcagtaattcagtttaangtcnnanaaaanaaaanaaaanaaaannaaaagggc

SEQ ID NO: 78426 - DNA, 453 bp, Zea mays
  Clone ID: LIB3079-043-Q1-K2-D4
ccacgcgtccgcctaagcaacttccatacccccagcgcggcggtgccggagcgagcagagcagccggagggcgtgtcggatccgccgccgtcaagatgaatgacgccgatgtatccaagcagatccagcagatggtgcggttcatccgccaggaggccgacgagaaggccaacgagatctccgtctccgccgaggaggaattcaacattgagaagttgcagcttgttgaagctgagaaaaagaagatcaggcaagagtatgaacgcaaagagaagcaggttgaagtacgcaagaaaattgagtactctatgcagttgaatgcttctcgcatcaaagttcttcaagctcaggatgatctagttaacaaaatgaaagacgatgccatgaaggaacttctccttgtcagccacaaccaccatgaatacaagaaccttttgaaagacctaatcattc

SEQ ID NO: 78427 - DNA, 330 bp, Zea mays
  Clone ID: LIB3079-043-Q1-K2-E10
ctagttctagatcgcgagccggccgccctttttttttttttttttttttttttttttttttttttttggggtttttttttttattttttttttatttttttttttttttttttttttttttttaaaaaaaaaaaaaaaattttttaaaaaaaaggttaaaaaataagggcaaaaaaactccaattatttttaaatataaaaaaaaaaaacttttccaattatattatttaataaaaaataaaaaaatgtaaaaaatcttttttatatgttcgccccactcaaatttataggaaaaaaaaaaaattctacttttttttaataaaactttta

SEQ ID NO: 78428 - DNA, 88 bp, Zea mays
  Clone ID: LIB3079-043-Q1-K2-E2
tccgaaaaaaaaaaaaaaaaaaaaaaaaaaaaaaaaaaaaaaataaaaaaaaaaaaaaaaaaaaaaaaaaaaaaaggaggtttgtttt

SEQ ID NO: 78429 - DNA, 58 bp, Zea mays
  Clone ID: LIB3079-045-Q1-K1-D10
attcccggcgcgagccactcatccgaagaaaaaaaaaaaaaaaaaaaaaagttttata

SEQ ID NO: 78430 - DNA, 366 bp, Zea mays
  Clone ID: LIB3079-045-Q1-K1-E8
cccacgcgtccgaagcgggccgcggtggcttaccctcaaccgctgaggtggacaaatatgcgagggaagtaccgcaaggatgctgagatctgcgtcaacgtggttgaggaatccgtgcgtgcatcacttggaaagaggaagaccgcacctaagctgccctctggcgcagacgctaagaagcttaagttttggttaggaaagaacaaagtagaagaagatgaaagtgatagtgacactgatgtggatgatgaggacattgaagatcttaagagcgcagatgcaaaatctgtagaagttgttgatggcatttactcaaaatggatgcagaataaatgaggagaagcttgatccttggttctgtttttg

SEQ ID NO: 78431 - DNA, 285 bp, Zea mays
  Clone ID: LIB3079-046-Q1-K1-D8
ctgactcttgggctccaactcactagtacttttccgcctcaatcaggggggcagttacctgtatctcttctcttagttgctctgactctattctttccaagtggaagaagaataggatgctgatgctcaagtgtaagctcctgaaaatgtgacatatatctacttaatcttatattagttacttattattttatatttttttatgtaaattacctttttttttattaattattatttatattattttatataatattttttctatttatttttttatatttttat

SEQ ID NO: 78432 - DNA, 235 bp, Zea mays
  unsure at all n locations
  Clone ID: LIB3079-047-Q1-K1-C10
gctattantctactcttttaaattcttgtgctccactgctggctatttatgctatatgttgggtacctcatgtcaaagtttatctcgtcgctgagctgtactaatcatattaattgtacgtgcgagtaagaagttgatgggtcaagttgtgtgtgtaatcggttgtgccacaacctgtacctaatccttcgcttcgcttaccacttaccaacttatttttatatttttttttttt

SEQ ID NO: 78433 - DNA, 226 bp, Zea mays
  Clone ID: LIB3079-047-Q1-K1-C2
ggacgcgctctgtatcggctcattaagcccgtcgttttttggtgtttttttatttttatcttttcttttttatttattttttttttttttttttttttttattatttatttttttttttttttttttcttttttttattttttatatttttatttttttttttttttattttattttttattttttttttttattatctttttttatttttttttttttatttttt

SEQ ID NO: 78434 - DNA, 449 bp, Zea mays
  Clone ID: LIB3079-047-Q1-K1-F4
gtcaaaggttgctgatgcgatggatgttctccacaatgtgtcccatcatcaaaactgaaacagtccgactattcagcttgctgcattatcactaaccgaaggcattatctcctaacttgaaagccataacaaactatcttcagtttgcaattgagtgatgtttccagaggttatctggcacatgacagtattgctccttttttttcttctatggttgtacttgagttctgttttcgtatatgcactcttctgtttactttcttttatgctattcatttatttttaatgtttttttctttttttcttttttgtttttttctttaatttttttatttttattttttttttattttcttttttttatttttttatttttttttttttttttttctttctttttttttttttttttattttttttatttttattttttttttttttttatttt

SEQ ID NO: 78435 - DNA, 374 bp, Zea mays
  Clone ID: LIB3079-049-Q1-K1-B9.F1
catgttaagctgtcatgattcgcgaatgaaactagcacataagtttattttttattcaggttacaaacctttacagcacaacaaattcccaccctgaagaaccgttatcaccttactaaacagttcgtctgaactaagctctcatatatgccctaaagccaaaacagcctcaatgcttcagcaagacagcaatgcccaataatctaagaggagcgtgtcactggtgtgcattaggagagttaagcaccgagcacgtgaagcatgatggcgttctgagcgtgcattctgttctcagcctggggggacacgattgagtttggagctcaatggggccgtcagtcactccactcctctctctgcaggaaacagtgcat

SEQ ID NO: 78436 - DNA, 624 bp, Zea mays
  Clone ID: LIB3079-049-Q1-K1-B9.F2
caatgttaaagctgtcatgattcgcgaatgaaactagcacataagtttattttttattcaggttaccaaacctttacagcacaacaaattcccaccctgaagaaccgttatcaccttactaaacagttcgtctgaactaagctctcatatatgccctaaagccaaaacagcctcaatgcttcagcaagacagcaatgcccaataatctaagaggagcgtgtcactggtgtgcaataggagagttaagcaccgagcacgtgaagcatgatggcgttctgagcgtgcattctgttctcagcctgggggaacacgattgagttgggagcctcaatggcgccgtcagtcacctccactcctctctctgcaggcaaacagtgcataaggtaggcctgtgggccagcaatctccatcagggcctcatccaccgtgaatccctggaacttctgttttctataatcagcttcttccttttgtcccatactggcccaaacatctgtgtacacaatgtctgctcccttaactgcttccctgggactgtttgttatttcaatcttactgattccagcactcctggcgatctccactgtgtttgcgtcaggctcaaatcccttgggacaagcacat

SEQ ID NO: 78437 - DNA, 435 bp, Zea mays
  Clone ID: LIB3079-049-Q1-K1-B9.R1
ggcgacggcagtatccgagctcgcactcgcgcacccgtccatcgcatcgcatctgtcctcccatcccctcagcgccaccgcaccgcaatcacacgcgcgccacccgcgatgacgccggcggcgcgatctccggctccagcagcggggtcgtcgtctcctccgcccgcctcaggcagccgttcacgctccctccgcgcaccgcttgcccaatcgccgccgccgcctcgcccgtgacccgccgcggggtcgcggtcgccgccgtgtcgagccccgttgtgtccgccgccgcggggaaggatgccaaacaggctcctaaggatttccttcaaatcattgattttgacaaggatacaataatggaaattcttaatcgagccatcgaggttaagggcttgataaagtctggatacaagagcttgcaaacgttcaaaggga

SEQ ID NO: 78438 - DNA, 664 bp, Zea mays
  unsure at all n locations
  Clone ID: LIB3079-049-Q1-K1-B9.R2
ggcgacggcagtatccgagctcgcactcgcgcacccgtccatcgcatcgcatctgtcctcccatcccctcagcgccaccgcaccgcattcacacgcgcgccacccgcgatgacgccggcggcggcgatctccggctccagcagccacgtcgtcgtctcctccgcccgcctcaggcagccgttcacgctccctccgcgcaccgcttgcccaatcgccgccgccgcctcgcccgtgacccgccgcggggtcgcggtcgccgccgtgtcgagccccgttgtgtccgccgccgcggggaaggatgccaaacaggctcctaaggatttccttcaaatcattgattttgacaaggatacaataatgaagattcttaatcgagccatcgaggttaaggcattgataaagtctggagacaagagcttccaaccgttcaaagggaaaacaatggccatgatttttgccaagccatcaatgaggacccgtgtttcatttgagacgggattctttttacttggtgggcatgctatttatttgggtccagatgatatccagatgggcaaacgtgaggagactcgtgatgttgctagagtactttctggctataatgacatcattatggctagggtctntgctcaccaagatattctggacttggaaaatatgcatc

SEQ ID NO: 78439 - DNA, 83 bp, Zea mays
  Clone ID: LIB3079-049-Q1-K1-F12
cacgacccatgaatgaatggtctttggctctttgtcctccagttcgttatgtgaactctgccgtgctactaaaaaaaataaaa

SEQ ID NO: 78440 - DNA, 606 bp, Zea mays
  unsure at all n locations
  Clone ID: LIB3079-049-Q1-K1-H5.F2
accatggaatctacatcaatattcagcaaatggcagaacaatattgttgttctatgcatgtgctgcgctgtgctgggcactcctcgcagatggaaagcgaagcgtggattgcaagtgtacatgcatcaagagaacatgcaatatcaacacgatcttctagtcttagcataaaatgcacagctcgattcacgatgattacaacaagagcctgttggaggggtaatttaaggtcactgccacttcctcttcacttgtcactagattacaatatctactcgccccacagtgaaagacataggcaatgaagattggtctagaaatcagtgtcgaagcacgatgtcatcaccttcgacacaatcgaccttgcgaaaggtatgtagctaaggctgtaccaaataagggcaccaaattccaaaatgatggccactagagtcagcagcttgctgcgaacgtagatagcacagaatagagcaattatgatgcttgcaatatatatagcagtggcatatattcgcacagaatcaagcatcatatcaaactgtcttttggggcctatgagaaatgctgtacttccaagggccatcaaattgncaagggtgaatgcta

SEQ ID NO: 78441 - DNA, 524 bp, Zea mays
  Clone ID: LIB3079-049-Q1-K1-H5.R1
cccacgcgtccgcacataggctctgggctctggcgctaatgttcgagcaaggcgctgctcctgttgctgtagaagggattttttgaccaaccctccaaccggtgcggcttcgatctttcctctcctatcacctgaatccctcgagtattcatcgccggcgcagcggtctcttcccttcgctggagaagggggaaggggacacgaacggagcagaaggccatggacacgatagcggaggcgcgcttggagcgggccaagatgctggtgggcatggaggtcgacgaggagtccgcgttgccaccgcccgaggagcagtccttcttcgacgacatcaatcggcactgcaccctcaacaccactcagaggctctatggtttcgcgatatgcttggctgccggactcacgtgcacattcttgtcaatgcttgtcttctacaatccagtgaaattttggggtacattcaccctttgcaattttgataacccttggaagtacatcattttctcatagagcgccaaaagaac

SEQ ID NO: 78442 - DNA, 647 bp, Zea mays
  Clone ID: LIB3079-049-Q1-K1-H5.R2
cccacgcgtccgcacataggctctgggctctggcgctaatgttcgagcaaggcgctgctcctgttgctgtagaagggattttttgaccaaccctccaaccggtgcggcttcgatctttcctctcctatcacctgaatccctcgagtattcatcgccggcgcagcgcggtctcttcccttcgctggagaagggggaaggggacacgaacggagcagaaggccatggacacgatgcggggcgcgctggagcgggccaagatgctggtgggcatggaggtcgacgaggagtccgcgttgccaccgcccgaggagcagtccttcttcgacgacatcaatcggcactgcaccctcaacaccactcagaggctctatggtttcgcgatatgcttggctgccggactgacgtgcacattcttgtcaatgcttgtcttcttcaatccagtgaaatttggggtagcattcacccttggcaatttgatggcccttggaagtacagcatttctcataggccccaaaagacagtttgatatgatgcttgattctgtgcgaatatatgccactgctatatatattgcaagcatcataattgctctattctgtgctatctacgttcgcagcaagctgctgactctagtggccatcattttg

SEQ ID NO: 78443 - DNA, 472 bp, Zea mays
  Clone ID: LIB3079-050-Q1-K1-C5.F1
catgcacaaacgtatatattagtccagatgaccgacaccatataagttctgtaataatcactagcagctcatttaaacaggcaaacacattcttatgctgtggtgcagcatctcgtacgttacagatatgagaggctaaaggtggttttatcaagataattccttcagtactcattagctagcacaaatcagcaaacacgacactgcaaatgaaacaataatacaaaccagcactacaaactagctagggaccacatgcaacatagttaagcagatcaactgcgctgccgtcctgtgcaacttggaggcagaggcagaccagacactgacagtaaggaatgttttgagcaactagtcagacgagggagttgtcatctcatcggtacaggcagcccctgttacgccggcgtccagtaagtcatgggcagtcccgtcccggtagtactttcggggttcacgagacaggggccag

SEQ ID NO: 78444 - DNA, 608 bp, Zea mays
  Clone ID: LIB3079-050-Q1-K1-C5.F2
catgcacaaacgtatatattagtccagatgaccgacaccatataagttctgtaataatcactagcagctcatttaaacaggcaaacacattcttatgctgtggtgcagcatctcgtacgttacagatatgagaggctaaaggtggttttatcaagataattccttcagtactcattagctagcacaaatcagcaaacacgacactgcaaatgaaacaataatacaaaccagcactacaaactagctagggaccacatgcaacatagttaagcagatcaactgcgctgccgtcctgtgcaacttggaggcagaggcagaccagacactgacagtaaggaatgtttgagcaactagtcagacgagggagttgtcatctcatcggtacaggcagcccctgtacgccggcgtccagtagtccatggcagtcccgtcccggtagacttgcggggtccacgagacagggaccaggcagagtcctctgtcactcaggtcgtgctctgcctcatctccctgcttgctcgtctctgcagcagcacgatgatctccccatgggaagtggttattacccttgctcctgctcgagttcgtgtacggctcgctgagtagct

SEQ ID NO: 78445 - DNA, 582 bp, Zea mays
  unsure at all n locations
  Clone ID: LIB3079-050-Q1-K1-C5.R1
gcagtctcgctgaaaagntaggcaacaagagccggatattgtgtcggcaaggagcagcagcagtggcagtggagcagcgagcgagcgaaagaagcgggcgtccgaggaaaggacgagcaccgtgaagaagtccaagcaagagggctctaaaccatctcctcccaagcagcaacaagtgcctaaagtgaagatcggagagaagatcacagcattgcaacagatcgtttcgccatttgggaagactgatacagcgtcagtgctgtttgaaacgatcaagtacatcaagttcctgcatgaacaagtacagctactcagcgagccgtacacgaactcgagcaggagcaagggtaataaccacttcccatggggagatcatcgtgctgctgcagagacgagcaagcagggagatgaggcaaagcccgacctgagtgacagaggactctgcctgggtcctgtctcgtggaccccgcaaatctaccgggacgggactggcattgactactggacggccgcctacaagggctgcctgtaccgatgagatgacgactccctcgtctgactagttgctcaaacattccttac

SEQ ID NO: 78446 - DNA, 661 bp, Zea mays
  unsure at all n locations
  Clone ID: LIB3079-050-Q1-K1-C5.R2
gcagtctcgctgaaagcagtaggcaacaagagccggatattgtgtcggcaaggagcagcagcagtggcagtggagcagcgagcgagcgaaagaagcgggcgtccgaggaaaggacgagcaccgtgaagaagtccaagcaagagggctctaaaccatctcctcccaagcagcaacaagtgcctaaagtgaagatcggagagaagatcacagcattgcaacagatcgtttcgccatttgggaagactgatacagcgtcagtgctgtttgaaacgatcaagtacatcaagttcctgcatgaacaagtacagctactcagcgagccgtacacgaactcgagcaggagcaagggtaataaccacttcccatggggagatcatcgtgctgctgcagagacgagcaagcagggagatgaggcagagcacgacctgagtgacagaggactctgcctggtccctgtctcgtggaccccgcaagtctaccgggacgggactgccatggactactggacgccggcgtacaggggctgcctgtaccgatgagatgacaactccctcgtctgactagttgctcaaacattccttactgtcagtgtctggtctgcctctgcctccaagttgcacaggacggcagcgcagntgatctgcttaactatgttgcatgt

SEQ ID NO: 78447 - DNA, 194 bp, Zea mays
  Clone ID: LIB3079-050-Q1-K1-E10.F1
atagaatagtggtggcatactattttacatacagtgtcaaggcgccattcttacactaaatttgacacaggacaagtaagaaacatagattgactgtgcaatcttcttccacaacaatcactacatcagctagtaataagtagtccgatccgaggagccctaaattatattgttggcgcatcacatcctgaacg

SEQ ID NO: 78448 - DNA, 443 bp, Zea mays
  Clone ID: LIB3079-050-Q1-K1-E10.F2
atagtaatagtggtggtcatactattttacataccagctgtcaaggacgccagttcttacactaaatttgacacaggacaagtaagaaacatagattgactgtgcaatcttcttccacaacaatcactacatcagctagtaataagtagtccgatccgaggagccctaaatataatgttggcgcatcacatctgaacgttgatgtgcctggtctcgtctcccggcgacagcgagaaggtggattgcgtcgtcctgttgttgtagctgacagtgaggacgtactcccccaggtagccggtgaagctgtaggcgccgtgcgcgtcggtctggccggccgcctgcagcgtccgccactcgttgagcaggcggtcgaccacgtcccccgtgggcaggttgctgaggttccagtccgtgaggcacatctggtagcacccgctggggtg

SEQ ID NO: 78449 - DNA, 311 bp, Zea mays
  Clone ID: LIB3079-050-Q1-K1-E10.R1
acccagcggtcgtacagatgtgcctcacggactggaacctcagcaacctgcccacgggggacgtggtcgaccgcctgctcaacgagtggcggacctgcaggggccggccagaccgacgcgcagggcctacagcttcaccggctacctgggggagtacgtcctcactgtcagctacaacaacaggacgacgcaatccactttctcgctctcgccgggacacgagaccaggcacatcaacgttcacatgtgatgcgccaacattatattgagggctcctcggatcggactacttattactagctgatgtagtg

SEQ ID NO: 78450 - DNA, 443 bp, Zea mays
  Clone ID: LIB3079-050-Q1-K1-E10.R2
caccccagcgggtgctaccagatgtgcctcacggactggaacctcagcaacctgcccacgggggacgtggtcgaccgcctgctcaacgagtggcggacgctgcaggcggccggccagaccgacgcgcacggcgcctacagcttcaccggctacctgggggagtacgtcctcactgtcagctacaacaacaggacgacgcaatccaccttctcgctgtcgccgggagacgagaccaggcacatcaacgttcagatgtgatgcgccaacattatatttagggctcctcggatcggactacttattactagctgatgtagtgattgttgtggaagaagattgcacagtcaatctatgtttcttacttgtcctgtgtcaaatttagtgtaagaactggcgtccttgacagctggtatgtaaaatagtatgaccaccactattactat

SEQ ID NO: 78451 - DNA, 78 bp, Zea mays
  unsure at all n locations
  Clone ID: LIB3079-050-Q1-K1-E3
tcttcctaaagaaaaaaaaaaaaaaaaaaattttaatttaaaaaaaaaaaaaaaaaaaatacggcaactgttanattt

SEQ ID NO: 78452 - DNA, 485 bp, Zea mays
  Clone ID: LIB3079-050-Q1-K1-F6.F1
acacaaacttgatcttccttcaacagccggtataagcttatatgataaaatcgatggccacctcactttacaaaaacaagctgaccggccaacgcaaaatcaggcccatggtagatcaccattccgcgtgatctgccagcgtatcacactttgttgttgagataatacaacacaacttatctccctccccaaatacacaatttacggcacatgtacaaaggagaaacacgaaagaattacgatgcttactgacctatctatgctctgaacaaatctgaactgtatgccgccgcaactcaaacctgtatgaactgagagagaaaaaattccgaagatgacagtgagctagccttgcatcaacaccgactcggtggcttttctcaacttgaaactatgcatgaactggctctctaaacttgccttgcagagacatccagttgtcacatctgttgtggaccactgtgaaagtcaaatcgtgaggccgc

SEQ ID NO: 78453 - DNA, 592 bp, Zea mays
  Clone ID: LIB3079-050-Q1-K1-F6.F2
acacaaacttgatcttccttcaacagccggtataagcttatatgataaaatcgatggccacctcactttacaaaaacaagctgaccggccaacgcaaaatcaggcccatggtagatcaccattccgcgtgatctgccagcgtatcacactttgttgttgagataatacaacacaacttatctccctccccaaatacacaatttacggcacatgtacaaaggagaaacacgaaagaattacgatgcttactgacctatctatgctctgaacaaatctgaactgtatgccgccgcaactcaaacctgtatgaactgagagagaaaaaattccgaagatgacagtgagctagccttgcatcaacaccgactcggtggcttttctcaacttgaaactatgcatgaactggctctctaaacttgccttgcagagacatccagttgtcacatctgttgtggaaccactgtgaaggtcaaatcgtgaggccgcaaggcactctgaactaggtcctgcactgttttgtttcgtctacagacatctgagatttcaccaaatctatctgttatggtatggagactggacccagaagcagcat

SEQ ID NO: 78454 - DNA, 667 bp, Zea mays
  unsure at all n locations
  Clone ID: LIB3079-050-Q1-K1-F6.R2
ctttgatcaacgagcatgggatacccgtaccatggagtcaatatgccgatcttgcaaatttgctgtaaggacatgtggaagggtcatgggaatgacgattggtgcaatgcttgaagaaatccaaactctctaccaacaacacaaacagtcttgttttctttacttgtccagtgaagttatcaagatttttggatctgatccatcttgtgcgggctatcttactaacttgatacaaatacttttcagccatacagtgcaacttctcagaacgattcaagattttactgccagaccagatatagctgatgattgctatttgttagcatcaagatgtatccgttactgtcctgatctatttatacctacagaaatgtttcaaagattggttgactgtgcaatggctggtataactatacaacacagggaagcctgtaaatcgatattgtcttttctatctgatgtcattgaccttccaaactcatctgacggnggacagtaccgtaaagttattaacacaatcatacttcaccgtggcgcaacccttactagaataatgattgctgccttaacaggggcgctaccatctggtcgtctggaggaggtttcttatgttctgctgtcacttagcagagtctntggtgagaacatgctgaactgngcaagggaa

SEQ ID NO: 78455 - DNA, 301 bp, Zea mays
  unsure at all n locations
  Clone ID: LIB3079-051-Q1-K1-B1
tgcagctgcaagaagtttgaagctgctgggattcaatgctgtcatgtactgaaagtncgggatctcaagaatatcaaagaacttccagaacaatatattttgaagagatggaggaaagatgctcgttctgttcaaattggggaggaacctacctatgggtctggcagtgtcatgcgatcaacctcagaagctcgattcagtatcatgtgtcggttggctagcttgattgcttcaagagctgccaaattcgaggatttgatttcatatatcgaaagttagtcaaatgcttttcagaaacatc

SEQ ID NO: 78456 - DNA, 583 bp, Zea mays
  Clone ID: LIB3079-051-Q1-K1-E9.F2
catacaaatattggtttatcatctccccaaacttacgagaacatcacagtacacgaatagcaactgtaaaatgtacagaccgagctagcagtttgcaattatttgtaacagatccaagctaaatacattcacatttgggtttctttgccgccttgccgggcacttccagatcatcgaacctgtcaggcggtggcaccggcaggtgtggcggattcacttgtcacggcctcagcctcccagaacgaagtcttcttgccagtcttggaaacagtttgcaggacggcgtcaggtgtcacattgcccttcacggtgaccttctgttccatgatgtctacgtcgtaggactcgacgccttccatcttgccgaggacccgcttgacagctccaacacagccctcacaggacatgccaaccttgagcacaacagtctgggccatagcgcgagaggggaggagggtcggggcggttcggcggtggtggtggaaatctcctgccggcgaaggcgaaggcgagggaggacgggggaaagatctatctgggccgggagagagggacggagttgggtgaggatatacaggcggcc

SEQ ID NO: 78457 - DNA, 632 bp, Zea mays
  Clone ID: LIB3079-051-Q1-K1-E9.R2
gggaaaagaggacttggcctcgccttcccttgcgtgtttaccgacgccaccggccgcctgtatatcctcacccaactccgtccctctctcccggcccagatagatctttcccccgtcctccctcgccttcgccttcgccggcaggagatttccaccaccaccgccgaaccgccccgaccctgctcccctctcgcgctatggcccagactgttgtgctcaaggttggcatgtcctgtgagggctgtgttggagctgtcaagcgggtcctcggcaagatggaaggcgtcgagtcctacgacgtagacatcatggaacagaaggtcaccgtgaagggcaatgtgacacctgacgccgtcctgcaaactgtttccaagactggcaagaagacttcgttctgggaggctgaggccgtgacaagtgaatccgccacacctgccggtgccaccgcctgacaggttcgatgatctggaagtgcccggcaaggcggcaaagaaaaaaaatgtgaatgtatttagcttggatctgttacaaataattgcaaactgctagctcggtctgtacattttacagttgctattcgtgtactgtgatgttctcgtaagtttggggagatgaaaaccaatatttgtatg

SEQ ID NO: 78458 - DNA, 247 bp, Zea mays
  Clone ID: LIB3079-052-Q1-K1-B9.R2
ggcgcttggattatacgagcatgggatacccgtgccatggaggcaatatgccgatcttgcaaatttgctgtaaggacatgtggaagggtcatgggaatgacaattggtgcaatgcttgaagaaatccaaactttataccaacaacataaacaggcaatgaatactttacttgtccaatgaagttgtgaggatactaggatctgatccatattgtgcgggctatcttactaacttaatacaaatactt

SEQ ID NO: 78459 - DNA, 92 bp, Zea mays
  Clone ID: LIB3079-052-Q1-K1-D12
aaaaaaaaaaaaaaaaaaaaaaaaaaaaaattataaaaaaaaaaaaaaaaaaaaaaaaggaaagaaaaaatgaaaaaaatatcaaataaaat

SEQ ID NO: 78460 - DNA, 476 bp, Zea mays
  unsure at all n locations
  Clone ID: LIB3079-052-Q1-K1-F5
tcgtctcgtcccacgtcgtctcgnngttcgtcctatgtagttctctcagnttgatgtcgccctggtgatccagtggaggagtcctcctctcggggnntttatgatcatactccactactccggcgtccgcactccatcgctggtccagtcccttctctcgtcgtctttccctcttactggcttcgtatgtctnnntctcatgaaccctactctgctccccatcattatgcctacgcnncccttcttcttcccactttcctcctccttcctcttttaccctttccatttctagtaagcatctactcgtgcctccgtctttctcttccgatgtcagttcttctgcctnntcgtcgtcgccgttttcaagtcgttcgcctaaataccttctttagcttgcatgccacttncctactgctgctagcaaaagacctttattactagtgtcaattaagttacgaaaaaaataataaatataa

SEQ ID NO: 78461 - DNA, 307 bp, Zea mays
  Clone ID: LIB3079-053-Q1-K1-B1.F1
ctcagtagcctaaatagctgtcactgacaaaaaccaggaccggaaactaaaatgtatacattaacaatacgcataaactgaatgtaatagtaagaaagaaggaatacaaatctgaggataagataaacaagaagtaagctcaagtgctatttactgatttacatattggaacatctaacaggtaatagcaaaactgtcaactgtggtatcaggaaaaataatcttctgtttgtccgcttagcctttatcagacctgagctcttacagggaactgcaaccaaacaatccggtacacccatacattgta

SEQ ID NO: 78462 - DNA, 598 bp, Zea mays
  Clone ID: LIB3079-053-Q1-K1-B1.F2
ctcagtagcctaaatagctgtcactgacaaaaaccaggaccggaaactaaaatgtatacattaacaatacgcataaactgaatgtaatagtaagaaagaaggaatacaaatctgaggataagataaacaagaagtaagctcaagtgctatttactgatttacatattggaacatctaacaggtaatagcaaaactgtcaactgtggtatcaggaaaaataatcttctgtttgtcgccttagcctttatcagacctgagctcttacaggtaactgcaaccaaacaatccggtacacccatacattgtagtcagatttgaaccaccaagggtaattatttgcgcaacatcacgaaattttataacagtaccaagcaacgaatgtccaataaacataaatcctcatagctgtatgctatataaagctctttactttcgttcatgatgtgcaacattctcgtaccatctcatattgcacagttcatttgccatggaagtacagatcttgcattcatacatctctctgcaaagaacagaataagcacctgtactgaatctcaatttggcaagaaataattttgcttcctccagaatatgcaca

SEQ ID NO: 78463 - DNA, 232 bp, Zea mays
  Clone ID: LIB3079-053-Q1-K1-B1.R1
cccacgcgtctcggccagcatgaaatacctacctacatagggctcgaatgaaatacctgaccactcctagaatgtcaccgttcacatattgatttggattccactttggtgttacacagatccgaattgcaacctgtattgcatttactggtagctctgtgtggaaaatgtgcatattctggaggaagcaaaattatttcttcccatattgagactcagtacaggtgcttat

SEQ ID NO: 78464 - DNA, 631 bp, Zea mays
  Clone ID: LIB3079-053-Q1-K1-B1.R2
cccacgcgtccggccagcatgaaatacctacctacatgggctcgaatgaaaaacttgaccactcctagaatgtcaccgttcacatattgatttggattccattttggtgttacacagatccgaattgcaacctgtattgcatttattggtagctcggtgtggaaaatgtgcatattctggaggaagcaaaattatttcttgccaaattgagattcagtacaggtgcttattctgttctttgcagagagatgtatgaatgcaagatctgtacttccatggcaaatgaactgtgcaatatgagatggtacgagaatgttgcacatcatgaacgaaagtaaagagctttatatagcatacagctatgaggatttatgtttattggacattcgttgcttggtactgttataaaatttcgtgatgttgcgcaaataattacccttggtggttcaaatctgactacaatgtatgggtgtaccggattgtttggttgcagttacctgtaagagctcaggtctgataaaggctaaggcgacaaacagaagattatttttcctgataccacagttgacagttttgctattacctgttagatgttccaatatgtaaatcagtaaatagcacttgagcttac

SEQ ID NO: 78465 - DNA, 448 bp, Zea mays
  Clone ID: LIB3079-053-Q1-K1-C11
agatttgctcttaacgaggcacagaaatcccttctggcggatcacaaatccctagaagctaggctgaggcacgccgagaacagggcgatgatgctggaggagatggtggataaactagagtcgcaatgcaaggcgctgtctgagacttcagaagttctgaagctgcaggccggagctagcatggcctctttgttctgctcgatccagtttgtgctgctgtgcatagccattgggaccctcctcgttcgcttcctgtcctcttctccggagattgtacctacttgaggttagagaattatgccagtcagcctttatgtaggcgttgttgaacggttggttactggaacttattagggcatcaatcgccttacagattttcggtttttgtaccatcaactcgattttgctagtaatttctttatgaatacgagtttactgcacttctggg

SEQ ID NO: 78466 - DNA, 94 bp, Zea mays
  Clone ID: LIB3079-053-Q1-K1-C4
atcggctaaaacaaacaaaaaaaaaaaatattaaaaaacaggaaaaaaaaaaaaacataaggaagatttacaacgggagaataggcaaaccaca

SEQ ID NO: 78467 - DNA, 216 bp, Zea mays
  Clone ID: LIB3079-053-Q1-K1-C9.F1
attccatcgactggaaaatattagagagcagaaacttcaataatccgtcattttgaacggaaccttgttctctcgagcattttaccatctggggacatttgaactagccttgtattctacacaatcatacagaatgggtgctaaaaatggtaggcagctgataacactgaaaaaaggaacaaaatctcaaacgaagtaatctacagcaataaacac

SEQ ID NO: 78468 - DNA, 487 bp, Zea mays
  unsure at all n locations
  Clone ID: LIB3079-053-Q1-K1-D2-F2A
gctctgcaacgcaaaactgggaagtctcgtacatgttcaagaggggcgcagcattcgaccagatgaagacgacgagcatggccaggatggctatctggcaaacgagcggtacaatgctgtactcaactacctcgaacaggtaccgtacgaacgtggccccagcgagcaggcctgcagacaaattcctgtccttccacagcaagatgtccgcggctgcgagaggcacagataacaacgggggtccatgagtaaaccgggccatgacgcacgcagatggcgtcgcctagctaatagtttcccagaaagaacaagaacagcagagagcagcagcgtacgtacctcgccctccaccgagaagctgatgaatcggcttgcgcctgctatggccgncgccgncgcccacccctcgtncgttgccatgatcgcttggaaaattagggtgcatgatgtctatgtgagttcgggggcgtataacctggtatatatc

SEQ ID NO: 78469 - DNA, 55 bp, Zea mays
  Clone ID: LIB3079-053-Q1-K1-D2-R2A
ggggtgggtgttttgatttttttaattctatataaatgtggctttgttcatattg

SEQ ID NO: 78470 - DNA, 333 bp, Zea mays
  Clone ID: LIB3079-053-Q1-K1-G11.F1
ggcgccttttttttttttttttttgccgaagttcaaattatcatacttatttattttcttctgtttcgatcttccacgatacattctacatgaatgatacaaatatctatccaacatagtctttggtccctacgtgaatcatactggctattgtgtacctacagttgacatatccaaagcagaggcgagctctatagcttgtcgaccttgtttacggtttatgcggataataaatggctttttaggatgatatactaacccttgctatgcccgtatttcatctggatgactttgatgttagtttcttaacgagactagtgttaccaggtacca

SEQ ID NO: 78471 - DNA, 554 bp, Zea mays
  Clone ID: LIB3079-053-Q1-K1-G11.F2
gccgaagttcaaattatcatacttatttattttcttctgtttcgatcttccacgatacattctacatgaatgatacaaatatctatccaacatagtctttggtccctacgtgaatcatactggctattgtgtaacctacagttgacatatccaaagcagaggcgagctctatagcttgtcgaccttgtttacggtttatgcggataataaatggctttttaggatgatatactaacgcttgcgatgcccgtagttcatcttgatgactttgatggtagtttcttaaccagactagtgttaccagttaccaatagtcgagcacccttcaccagctcctccttaatcataaaaagcaaagcagaagcaaaaacactttgcacaatttttgtgcccattcctttgtacatccctgacagaccctcatatcgtaccatctttgtgaacgcatcaagtgtacctttgtagcgatgcctcttgtcatcgttaatcatgtgctttgcctgaagtcttgccttaacaactagaaggggatacgtaacgacggttgcaccaag

SEQ ID NO: 78472 - DNA, 329 bp, Zea mays
  unsure at all n locations
  Clone ID: LIB3079-053-Q1-K1-G11.R1
ctatggtgcaacggtcgttacgtatcccttctagttgttaaggcaagacttcaggcaancacatgattaacgatgacaagaggcatcgctacaaaggtacacttgatgcgttcacaaagatggtacgatatgagggtctgtcagggatgtacaaaggaatgggcacaaaaattgtgcaaagtgtttttgcttctgcttngctttttatgatgaaggaggagctggtgaagggtgctcgactattgngtaactggtaacactagtctggttaagnaactaccatcaatgtcatcaagatgcactacgggcatcgctagcgttaggatatc

SEQ ID NO: 78473 - DNA, 554 bp, Zea mays
  Clone ID: LIB3079-053-Q1-K1-G11.R2
cttggtgcaaccgtcgttacgtatccccttctagttgttaaggcaagacttcaggcaaagcacatgattaacgatgacaagaggcatcgctacaaaggtacacttgatgcgttcacaaagatggtacgatatgagggtctgtcagggatgtacaaaggaatgggcacaaaaattgtgcaaagtgtttttgcttctgctttgctttttatgattaaggaggagctggtgaagggtgctcgactattggtaactggtaacactagtctggttaagaaactaccatcaaagtcatcaagatgaactacgggcatcgcaagcgttagtatatcatcctaaaaagccatttattatccgcataaaccgtaaacaaggtcgacaagctatagagctcgcctctgctttggatatgtcaactgtaggttacacaatagccagtatgattcacgtagggaccaaagactatgttggatagatatttgtatcattcatgtagaatgtatcgtggaagatcgaaacagaagaaaataaataagtatgataatttgaacttcggc

SEQ ID NO: 78474 - DNA, 139 bp, Zea mays
  Clone ID: LIB3079-053-Q1-K1-G3
ggacccccccttgaaccgggccttaagccccgccggtgtggggggtacccccaaggtgaccggttcacttggcaagggcctaacggccggttctttcggtttcttccctttctttcttggcaacttcggcgggttttcc

SEQ ID NO: 78475 - DNA, 344 bp, Zea mays
  Clone ID: LIB3079-054-B6-F1A
gaaccaaaagggcccaaaaaaaggtcctagccaaattattctaaaaaagttccgcagtcagaaaacccattgcagttttaagggaccagggtttaaacacgtttgggaaagtactcagaagccaaaaaattggggaaaaatcccgctttttagaccatttaaattgccgcaccaggattgctgaaaacccccggaaaatcacccttaattgggccaatgaaaaaaatttcgggagcatcgaaacgggtaccaaaaatcttaagggggacctaaccctcttttggaattttcaccgttccatcagaagttgggaatttgggcaaatccccggatgggaaccccaa

SEQ ID NO: 78476 - DNA, 454 bp, Zea mays
  Clone ID: LIB3079-054-D6-R1A
tacaatttatattcaatattaaaaacatcttagcatgatgttctactggttagacagcttcacccagtgtctttcgtccttcttccatcaggacatgggttcgaaccccacgcgtgcgtctagcctgtgccggtcgccgtttggccatctatatagacgtgcagcagattaatttgaaatagctgaggggttattttagaaagatgacgcatgatgaccgttgaaattggtgctttaagtatagtatagaattcttggaaggttttgctattctacttatttgtgatacataaacttgcccattttttcttggtatctactatgaacttaactgatgcatttgataatataatgatttcttttgagcctgttcattagatgtaaattaacacagtatccatttacaaccaattcttttgcatttttacaattgaccttttcattttcatataaa

SEQ ID NO: 78477 - DNA, 86 bp, Zea mays
  Clone ID: LIB3079-054-Q1-K1-A12
aaaaaaaaaaaaaaaaaaaaaaaaaaaaaattaaaattaaaaaaaaaaaaaaaaaaaaaaaagaaagggtttaaaaaaaaaaaaaa

SEQ ID NO: 78478 - DNA, 394 bp, Zea mays
  Clone ID: LIB3079-054-Q1-K1-A9.F2
gcaaaagaagagagagcagaaaccacaacaacccgacacggagaacggaaccaggcccagacgagcaggagaccaccaggggacataggaacgagccgggcacgcgacacaaacacacagagtgggggcgacaaaagggaaggcagctgacaacacagaaaaaaggaacaaaaacccaaacgaaagaaaacaacaggaaaaaacactgctactggcaggcgatccgatcctgggaaactcaagcaaagattcttgcaggtcgaacactgacccaatcaaattgggcagactgattatgtggcaaagcttctgtcgtcagcaagccccaatactggaactatgaaaccctttggcatttactggtggatcaatcattactgagtacacggggagc

SEQ ID NO: 78479 - DNA, 506 bp, Zea mays
  Clone ID: LIB3079-054-Q1-K1-A9.R2
cccatgcttccgcaaattaatgctcgttattcttgattagatgcatgcatctttgcggtcagatgaataaggtttgaactaatatccatatattctgtacttaccaccacatcgcactattgttttgcttgctactagtgcacatgtaaaaaatattaaataaacaaagaagcttgcctgatctatttacatacactgtaaatacagtttttagtggtgtattttaattacttacacaaaccagtattcatctcaaaagccatgaacagctattcttatcccttccatttcattgaaaaatgaaggctctcgttgggatgaagaaacgcttcaaccttcaatatacctgaacaacctgccagacaagatttcagagggtactcgtgtgctagttgttgacccaatgctggccactggaggaacaatggctgctgttattgacttgataattgagtgcggtgttactagcatgcagataaaagttatatttgatattgcattacctc

SEQ ID NO: 78480 - DNA, 64 bp, Zea mays
  Clone ID: LIB3079-054-Q1-K1-E7
aaaaaaaaaaaaaaaaaaaaaaaaaaaaaaaaaaaaaaaaaaaaaaaaaaaaaaaaaggaagag

SEQ ID NO: 78481 - DNA, 64 bp, Zea mays
  Clone ID: LIB3079-054-Q1-K1-H1
aaaaaaaaaaaaaaaaaaaaaaaaaaaaaataaaaaaaaaaaaaaaaaaaaaaaaaaaaaggga

SEQ ID NO: 78482 - DNA, 385 bp, Zea mays
  unsure at all n locations
  Clone ID: LIB3079-054-Q1-K1-H9
gcaactataactggtttcatccacatccaatccacccattcgcctcgtcctttgaaattcggtccgggggattggatcttataccatgtgggaagagcggagcagtgatgctgcattcagtcatcgctgatccctctcttattcgaaaacagtctgtagcatgttcataatagctattagctagaactagaaatgattcgagggcaatttcagaaaatgctaaagaaacatatgctgtatctcaaggttttagctctgacatgattctgtatgttcctagatataagaacgcatacattctctattcaaaataaaatgctcagaggagataaatttgtctcnnaaaaaaaaaaggtataaaaaaatgtattttttttaataaaaa

SEQ ID NO: 78483 - DNA, 69 bp, Zea mays
  Clone ID: LIB3079-055-Q1-K1-A10
cccacgcgtcctacaaaaataaataactgttcaaaagaaaatacaactaaaatagggggcgggggaatc

SEQ ID NO: 78484 - DNA, 567 bp, Zea mays
  unsure at all n locations
  Clone ID: LIB3079-055-Q1-K1-A7-F2A
gctgaagtcagtgctaacatgacatatgatgctttgagcaaagatgtccatcatgttcagccagtgacagacaagatgttacttgatccgatttcttgtgagataattcaggactctggaaaaccagaaggctgtctacaaggatttccatggccgaacaccattgcatcattgtgtccaaaagaaaaatgatgagctcaccaagcatctgctgaagaggggtgcgagaacgacaattaaagatggcggaggtctgactgctctggagagaagaatggaacttggagcgataactgatgaagacttattcatactatttgtgaggtgatgttgcaaacttgcaatacaggcctttggcaactagctgnttgtacctgatagcattgtattgtacccacctaatttagcttctggaaagaacatgatttctacacctgaagacaaatgcctnttactgtaccacgatataacttatgggactgctgcgcttggctgngttntaaaattccactggtcgacatgaccacatcgttggtttgtacaacaattataggcaatcacagtatt

SEQ ID NO: 78485 - DNA, 485 bp, Zea mays
  Clone ID: LIB3079-055-Q1-K1-A7-R2A
catacctcaataaccatactcaaagaatcgaatactgtgattgcctataattgttgtacaaaccaacgatgtggtcatgtcgaccagtggaattttaaaacacagccaagcgcagcagtccatggggatatcgtggtacagtaaaaggcatttgtcttcaggtgtagaaatcatgttctttccagaagctaaattaggtgggtacaatacaatgctatcaggtacaaacagctagttgccaaaggcctgttttgcaagtttgcaacatcacctcacaaatagtatgaataagtcttcatcagttatcgctccaagttccattcttctctccagagcagtcagacctccgccatctttaattgtcgttctcgcacccttcttcagcagatgcttggtgagctcatcatttttcttttggacacaatgatgcaatggtgttcggccatggaaatccttgtagacagccttctggttttccagagtcc

SEQ ID NO: 78486 - DNA, 95 bp, Zea mays
  Clone ID: LIB3079-055-Q1-K1-D10
aaaaaaaaaaaaagaaaaaaaaaaaaaaaataaaaaaaaaaaaaaaaaaaaaaaaagaaaagagaaaataaaaaaaaaaaaaaaaaaaaaacaaa

SEQ ID NO: 78487 - DNA, 381 bp, Zea mays
  Clone ID: LIB3079-055-Q1-K1-F8
atcttctccagaagcaccataagtcttgtcttgggcattacaccagggctagccggtctgctacttggcactctcagtctgaagttctggaggagcgacagatccagcttcctgcttatcttggctcagggatttgtttggcttccaaatggtttgttggtcctaaaatagtcagaatcacatgacatctgtgctatagatatggacctcagtggttttctccacattaggaaagctggaagagccgttttgaactcaatttttttgctaacaagtgttgtatggtgaaacagagttttgtgtgtatgtaccaacaactaaaatgtaaacacgacattatcatagttgagtccaggaataataatctctatatctaatggc

SEQ ID NO: 78488 - DNA, 83 bp, Zea mays
  Clone ID: LIB3079-055-Q1-K1-G2
aaaaaaaaaaaaaaaaaaaaaaaaaaaaaataaaataaaaaaaaaaaaaaaaaaaaaaaaaggaaagaataaaaaaaaaagaa

SEQ ID NO: 78489 - DNA, 64 bp, Zea mays
  Clone ID: LIB3079-056-Q1-K1-A11
aaaaaaaaaaataaaaaaaaaaaaaaaaaaaaaaaaaaaaaaaaaaaaaaaaaaaaaaaagagg

SEQ ID NO: 78490 - DNA, 298 bp, Zea mays
  Clone ID: LIB3079-056-Q1-K1-A12
gcggcgtctcaggtcgggactttctggcaagacgaccttcaaagcgtggttcacatggacgtcgggcaaagccaggagatcgctcccacctcttccaacagctacaacggttcattgcagacagtccacatgaaaatggagctttgaggcatggccggggaaaaagaaagaaagaaaaccccagtccgaagctcgacgccgtcgtcccccctgtacatacggagaagagaggacacagctcgcaccggaagcagcgggctcttggggggtccaatccaacctaacgacgttggcccct

SEQ ID NO: 78491 - DNA, 292 bp, Zea mays
  Clone ID: LIB3079-056-Q1-K1-C1
gcatgagggactggaaagaggtttatacactacgttgcctctccagggtgctctagcttcgactgtttagatctaagggttgggggggcccgccctgcctatgatgatggaaataggtctagagagaggattcagaactgcattgagtgactttgtacttatgcagctccagttagcatctgtgttcttcacattctctcttgggaccaaaactcactactactgaaccacactgctacattgaggagctgaatatagagctacagtgcgtggatttgtggtgtttcatgcc

SEQ ID NO: 78492 - DNA, 213 bp, Zea mays
  unsure at all n locations
  Clone ID: LIB3079-058-Q1-K1-F10
cgctgatnntttctttgaaaaacctgtgtttattgtttccttaaccccaagaaatgggtgtactcctaaaatcataaattgcctctccaaacaaaaattagggcaaggggttaaaattggtattggaagttaaacctttaaaaattctttacttggcttccttaccattttcctgggttttatgaccaaaattccaatttttcccaaattggg

SEQ ID NO: 78493 - DNA, 139 bp, Zea mays
  Clone ID: LIB3079-059-C9-F1A
atgggggttatggatgcatattaatgattgaagggaatggggaagtatttttaaatagggtaaaaagaaagggcccggggccgggggacgccccaggaaaacctgaacggaatcccgaagggaagaaatttccccaaaa

SEQ ID NO: 78494 - DNA, 70 bp, Zea mays
  Clone ID: LIB3079-059-Q1-K1-E8
gcactcttactctcattttcacagacttcttccattccacattcaccataacactatagcatatcatcaa

SEQ ID NO: 78495 - DNA, 66 bp, Zea mays
  Clone ID: LIB3079-059-Q1-K1-F11
aaaaaaaaaaaaaaaaaaaaaaaattattaaaaaaaaaaaaaaaaaaaaaaaaaaaagaagaaaaa

SEQ ID NO: 78496 - DNA, 262 bp, Zea mays
  Clone ID: LIB3079-059-Q1-K1-F2
ctgaaactggcgtggatatgctgtacgtcgtgtcctgcttgctgtcggtttctgaagcttttagctggcagggacaggctgctgttggctttgctgattgcccaaccctctcctgtaatattaatcctaccagagaaacttaaacttgactcaaccgatatgctattaaataaataaagcaagcaagttaggataaaaaaaaaaagcaaaataataatgaggcaccaataagaaagactaaagaaaaccaattcataaaaat

SEQ ID NO: 78497 - DNA, 312 bp, Zea mays
  unsure at all n locations
  Clone ID: LIB3088-001-Q1-K1-G6.F3
acgtgttaacccgccggccaggnccgccgcgtaggcgtagctcccaatccaatctgctagnacggccggcaggnacccgttcttcgtgtcgtgtcttccgaggnaagaaggtcatcagtattcagtagcggtaggtaatcgtgagtgtgcccggtgtacgtatggcgaaggaagtaggcaggcgactgttgtataggctggtggaggcaggcagggtacccgatcatctgcgacgcagcaagctcagctgcaatggcaatggcgccgttcgttccgtatgtaaaaaaatggcggaaataattaatcgcatcg

SEQ ID NO: 78498 - DNA, 281 bp, Zea mays
  Clone ID: LIB3088-001-Q1-K1-G6.R3
cgcccggcgccgggtcgtacaccagccccgggtcgacggcgcgggacgggttcacgtacccggcgccctgctgtagaagctcgcccgcctgtactgctcgtccttgatcggcacgcccgcgtggtccgccgtgcccgacgacgtcatgatcgccgacttgatcgccgcgggggaccagctcgggtgcaggctcttgatgatggccgcgatgccgctcaggtgcggcgtcgacacggacgcgtgggcggacgcgtgggcggacgcgtgggcggacgcgtggg

SEQ ID NO: 78499 - DNA, 216 bp, Zea mays
  unsure at all n locations
  Clone ID: LIB3088-002-Q1-K1-F12.F3
tcggctgcgctcggacagctggctgccgcgttggnaagggcagnagtttcagnaattagtttcagacaaaactggaatgcaggnaggctttagtttgttgcagtgaggaagatgtacatggcacttaccggctatgttgccctgatacgagggatatggatacgggatacgtcgatactctgatacgctatttatcaaaaaatactctgatacgct

SEQ ID NO: 78500 - DNA, 150 bp, Zea mays
  unsure at all n locations
  Clone ID: LIB3088-002-Q1-K1-F12.R3
tgtcgttcgcttgctgnaagggtgctngtcatctanaacaggtagnanacactgcactgtaatgatccaattagacggctggttttcctgtcaatgactgcaacccccgttttttcctttgagagaaatgcagcccatcagctagagttt

SEQ ID NO: 78501 - DNA, 316 bp, Zea mays
  unsure at all n locations
  Clone ID: LIB3088-003-Q1-K1-A9.R3
tcaccctanaacacttaaaacacgcaaggcacaactcctgctcaagttcaagactcatgatcctttctactcaatcagatcatcatcgtcatcaggaagaggttgtgcagctgctgcagcaagctcagcttcatgctgctgctgcatagccatgtcgatggtaacttccggaggcttaagagcaacagcttcaacaaagtgaaggttcggatcaccagccagcttccttgcgaggtacaggaaaggtttctcaaagttgtagttgctcttggcagaaatttcatagtactgccggacgcgtgggcggacgcgtggg

SEQ ID NO: 78502 - DNA, 196 bp, Zea mays
  unsure at all n locations
  Clone ID: LIB3088-026-Q1-K1-G1.F3
tctctgcttccttgacgcacttgctttgcagcattccttggtattctactctcgaaacatacatcatgccacaanaaccgatggttcgtgatggcaagagagctgccctaattgttccattgtaaccttgtaattgtgttcttccgcaggagaaattggttctgcacaaaacaccaataatcccggagtggagcaa

SEQ ID NO: 78503 - DNA, 376 bp, Zea mays
  Clone ID: LIB3088-013-Q1-K1-B2
acggttggcttctcctccccctccggttcgggttcgggttcgtgaggttctccggggttcggtggggtgggtgagcggatcgagatggcggcgtcggatgttgagtaccgctgcttcgtcggcggcctcgcctgggccacggacgaccactcccttcacaacgccttcagcacctacggcgaggtcctcgagtccaagatcatcctcgatcgggagacgcagaggtcccgcggcttcggcttcgtcaccttctccacggaggaggcgatgcggaacgccatcgaaggcatgaacggcaaggagctggacggccgcaacatcaccgtcaacgaggcccaatcccgcggcggccgtggaagcggcggcggcagcgggt

SEQ ID NO: 78504 - DNA, 470 bp, Zea mays
  unsure at all n locations
  Clone ID: LIB3088-013-Q1-K1-B3
cccacgcgtccgggcgactgggtctacgagaacaacggcgggacctgcgtggccatcgccggcgccgattactgtgtcgtcgcggcggacacccgcctctctgtcggatacagcatcctcacgcgcgaccactctaagatctgcgacctggctgacaaatgtgtactagcatcttctggctttcagggtgatattaaagctctgcacaagaacctagctgccagagaattgctataccaacaccagcataacaaaaggatgagctgccctgccatggcacagctcctctccaataccctgtactacaagcgcttcttcccatattacgccttcaatgtgctcggtgggcttgacagcgaggggaaagggtgtgttttcacctatgatgcagtaggttcctatgagagaactggttatagtgctcagggaacgggatctactntgattatgccagtcctggacaatcaact

SEQ ID NO: 78505 - DNA, 377 bp, Zea mays
  Clone ID: LIB3088-013-Q1-K1-B4
acgcggacgcgtgggcggacgcgtggggtgaagatgaagtatcatgtgttctaactccagactggttgaacgattctgttgaggagtccactgcagagaaggatgtggcttctgatggggatgaggctgagtcaacagggattgttattagaagccatcaccctgctccaagatcaagctcagagagttcattcactcaacagggaactgctatgcaaaggctgcggctacagtcaggccttaacaaaggccagcgtcctagtactgatgattcatcaagctgcattattgacgaaccaggaagtcagcacaaagcagaaaaagcataaattgaagaagatgccagttcaaacctcgctggaagtgctgatgatcta

SEQ ID NO: 78506 - DNA, 386 bp, Zea mays
  unsure at all n locations
  Clone ID: LIB3088-013-Q1-K1-B6
cggacacgcgggctaagttcacagctcccatcctggagcaagcgcacagtagcggatcatgatgcggacaggagaccggtcatagccgtcgctccagctactctcgctgggcctgaagcttctctactgtttcacctgaagcagcaccgttggtctcgaggagggacagaagacgtggtgcatcgcgaagccgtcggcgtcgaacgagatcctggcgcagaacctggactacgcgtgctcccaggtgagctgcgccgtgatccataatggcgggccgtgctactacccggacagccccgagatccgagccagtcgcgccatgaacctatactacgcctacagaggcaggcacccctggaaactgtactgcaacaactncgagctcg

SEQ ID NO: 78507 - DNA, 448 bp, Zea mays
  Clone ID: LIB3088-013-Q1-K1-B7
cccacgcgtccgcccacgcgtccgagcacacaagctttctcatggccatagcggacacggtggacatggggcctttggaggctatggtcacggtggttacggccacgggtatggtggccacggcaagttcaagcatggtcacggccaccacggcaagttcaagcacgggcacggcaagttcaagcatggcaagcacgggcacggcatgttcggcggcggcaagttcaagaagtggaagtgatgtgccctccatggttgatcgtagctgaactcaggcttccaggacatgtgttgccagtaataccttttcagcgttactcatccttcatctgtatttccagtaatccagcttgtggcgagtgacataatgctaataagtgacataaataaccatttgctgatatgctgtatatgttggtcttgtggatggagcgctctgaagaatata

SEQ ID NO: 78508 - DNA, 261 bp, Zea mays
  Clone ID: LIB3088-013-Q1-K1-B8
cggacgcgtggggcgcgggtttaacggatggtaggtttcagggcagcctgtctgcagctggaccgacgctcattgcaaagggacgtgttcttaagcacacgagtttatatctctcttaggccttgaacaaccaaagatcggcatggtctacgtttctcttgtcggtggttacttcacctcattaaaactcattaaaatgattgacacgcgacagattattgggttggcaactcctttgtgggaactgcatgcataactaag

SEQ ID NO: 78509 - DNA, 461 bp, Zea mays
  Clone ID: LIB3088-013-Q1-K1-C3
acgcctctccctccgcgccgccaccgtgccgcccgtccttctccaacagcaacgtgacggcgacaaggatctggtcctgatccggcagctggaagccatccgcgcgggcgtgtcgcagctgaaccacctccgctcgtcgtcccctcccccgccgcttccgccggcggagctggtcctctactcccgcctcgcccccgtcgcatccgcctgctccgcgcacccggacctcctccaccgctacatgtcctacaccccttacgcgccctgccccgacgacgccctttccatcgccgagcccctcctcctccgcggatgccatccgctcccgcgtcgcagatgcttctccccctccaatcctctcgggatccccttttcaccaaatcaaccctcagttaagcagtgaacatcggggaaatgacacggaattcatccatcagccgaggatcttcttcgaagcaaat

SEQ ID NO: 78510 - DNA, 463 bp, Zea mays
  Clone ID: LIB3088-013-Q1-K1-C4
caacaattagtaaacaacctaaagctcgcatgactggtcatcagaagcttgtaaaccatgggtactttggccctgatggacaatggttggcaagtgcatcctttgataaatctgtcaagttgtggaatggtatcacaggtaaatttgttgcagcattcagagggcacgttgcagatgtctaccagatcagctggtctgccgacagtaggcttctactaagtggaagcaaggattccactctaaagatttgggatattcgaacacacaagttgaaaatggacttgccgggccacgcggatgaggtgtacaccgtggattggagccctgacggtgaaaaagtggcgtctggtggcaaggatcgggtcctcaagctatggatgaactgactgacgaatattctatggatgaactgattgattattatatatctatgcttgggcgaattatatattgtagtgatgat

SEQ ID NO: 78511 - DNA, 451 bp, Zea mays
  Clone ID: LIB3088-013-Q1-K1-C5
cccacgcgtccggccgaggtctagtcaatctggacatttctggaccaaaagcgaatcctcgtgctgatattggagttgactttgattcaatcaatcgcaaggagaaaaggcaggaaaagaaaatcaaccaagcacctgtggtgtctacagtcaccatgggcaaggccatgggagctggttccggcattggtcgggctggtgtaggtgcaatggcacctcctcctaaccaaatgggtgccgggaggggcatgggtatgggtcctggtgccggtgccggttatggtggtggaatgggaatgaaccggccaatgggcatggggatgggaatgaatcaacaacagatgaggatggggatgaaccaacaaccgatgggaatggggatggggatgaaccaacaaccgatgggaggaatgaacatggtgatggggatgaaccaggggatgccgatgcg

SEQ ID NO: 78512 - DNA, 393 bp, Zea mays
  Clone ID: LIB3088-013-Q1-K1-C6
acacggtgtactacatggctccgctggccacgctgatcctgtcggtgccggccgtggcgcgggatggcggcgccgtgctggggtggctgctgacgcacgagtccgtgggaccggcgctggcggtcgtcgtcaccttcggggtgctggccttatgcctcaacttgtccatcttctacgtcatccactccacgacggcagtcaccttcaacgtggccggcaaccttaaggtggccgtggcggtgctggcgtcctggatggtgttccggaaccccatctgcgtcatgaacgcactcggctgcagcgtcacgctcgtcggatgcaccttctacggctacgtcaggcaccgactctcgcagaaccaggcgcccagagcccgcttggagatgcagatgc

SEQ ID NO: 78513 - DNA, 404 bp, Zea mays
  Clone ID: LIB3088-013-Q1-K1-C7
gctctagatcgcgagcggccacctggaagctcaaccagaccctttccctgcggcgctaccggtgagcacatacaactcgatgttctgctactgcggaacctacctcatgcatgctctgatagtatttggtatttttgttgcatcgttaaattatgctacccatgttacaagctccttgaactctgttatcagtgtaccatggagaaatcgaagccaactatgtttgtggttatcctgtgttatctcaatgaaaatgatggtttagttgactattaaaaaacgtcaacgtactacaatgcggttgaactcttattaaatgcaaatggtgggactatctataggatcctagtttacttacacctgcatccgacggaatgtctgttcaatagtgtcccttaaattaa

SEQ ID NO: 78514 - DNA, 456 bp, Zea mays
  unsure at all n locations
  Clone ID: LIB3088-013-Q1-K1-C8
acgtgaggacgaagtgaaggccaagaagactcggctgttcggcgccaacccaccgatcctctacgttctccactacttggggcggaagccatggctgtgcttccgggactacgattgcaactggaacgtcgagatcttgcgggaattcgcgagtgacgttgcgcatgcccgctggtggaaggtgcacaacaagatgccgaagaagcttcagagctattgcctcctgaggtcaaggctgaaggctgggctggagtgggagcggcggcaggccgagaaggcgaacttcaccgacgggcattggaaacggaacataaccgatccgaggctgaagacttgcttcgagaagttctgcttctgggagagcatgctatggcanctgggcgagaacaagaacaactngacgcagagcagcgcggtgccggcaacacctgccgcgacgagcctgtcgagctcgtg

SEQ ID NO: 78515 - DNA, 399 bp, Zea mays
  Clone ID: LIB3088-013-Q1-K1-D1
ctcctctctcgcatccgcagcctctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaagtgctggagctggccggcaacgctgccaaagacaacaagaagacccgcatcatcccgcgccacgtgctcctggccattcgcaacgacgaggagc

SEQ ID NO: 78516 - DNA, 462 bp, Zea mays
  Clone ID: LIB3088-013-Q1-K1-D2
gcgccaaaagaaattctgtacccactgaatcctcacagtttgagagcatggatgggcctaaatcgtttccccgatggaacatcgcagttcgggggctttgcaaggcctacctttgtgcctgctgcaccttctcagtttgggagcatggctcaacctaattatgtgcattcttctcaatcctctcaattcacaagcttggttcaaccgaattctgtacctcctgctgagtcctcgcagtttggaagcaaagcccaatctagttctgcaccccttgctaaaacctctcagttcaagggcatggctggaccaaattctgtatctcctgctgagccctctcagtttgggagcatgattagacctaatttggtacctcccgcatcttctcagtttttggggagcatggttcgaccaaattctgtaactccagaatcctcacagtttgggagcatgaccagaccaaac

SEQ ID NO: 78517 - DNA, 366 bp, Zea mays
  Clone ID: LIB3088-013-Q1-K1-B1
acgaaaaaaaaaaaaaaaaaaaaaaaaaaaaaatttaaaaaattaaaaaaaaaaaaaaaaaaaaagggaaaatggaaaaaaaaaaaagaaaaaaaaaaaaaaaaaaaaaaaaaaaaaaaaaaaaaaaaaaaaaaaaaaaaaaaaaaaaaaaagggctccccttttaaaggacccaatttaacctccccttttttcaaaataaaaaccttttttttaattccccctaaattaatttaaaggcccttcttttaaaaaccctttatttgaaaaaacctttagtttcccaaactaaaaccctttttaaaaattcccctttttccaaattgtcctaataccaaaaaccccccaaacatattcctttccaaa

SEQ ID NO: 78518 - DNA, 356 bp, Zea mays
  Clone ID: LIB3088-049-Q1-K1-F6
catatacgcagtcgcgtagcatgttttcttatggtaatgcatatgcatgataggaagaggtccagaatcgcgacagagttgcagaggtcacgaatgaagctgatgaactaaataatatcaacaaaagtaacaataattatctaagaaagacaagccaattgcaagcacaaatagagatgccactgttgaatatcaagctgattaccaaactattggattgccaaatatcattgagaatatttcaaaaactggtcacattcttgctgagatgcttagcgaagaacaagggctaaatctagagatagattaaaacatacctgatattggtttgacaatctttaaaggacagatggagc

SEQ ID NO: 78519 - DNA, 251 bp, Zea mays
  Clone ID: LIB3088-049-Q1-K1-F7
cccacgcgtccggccacgcgttcgaggagctcgacggtcgcaacatcaccgacaacgaggcgccagtcgcgcggcggccgtggaggcggcggaggcagatacggaggctggcgccgtgatggaggcggctacggcggaggcggtggaggctacggcggcggtcgcggaggctacggctgccgtggcggatacggtggtgcacaccgcggcggcggctacaggaacaacgacgggaactggaggaactgagc

SEQ ID NO: 78520 - DNA, 380 bp, Zea mays
  Clone ID: LIB3088-049-Q1-K1-G1
cccacgcgtccgcccacgcgtccgctgcgtcataacaactggaacagcagacacagggaatgggatgctattaatgatttaagagctgacatgggtagacttcagcaagggatgagcagcatgcagaggatgctggaagcgtgcatggacatgcagctggaattgcagcgttctgtgagacaagaagtgtcagctgccttgaatcggtttgcaggacctgaaggattgtcgatggatctgtgtgacgatggatcaaaatggaatcaggtgaggacaggaacctgctgcgtatgctgtgattcacagattgattctctactgtacaggtgtgggcacatgtgtacttgctcgaaatgtgcaaatgagctggtgcgcagcgg

SEQ ID NO: 78521 - DNA, 449 bp, Zea mays
  unsure at all n locations
  Clone ID: LIB3088-049-Q1-K1-G2
accacgcgtccgcaacgactcatagacaatctgcctgatgagtttgcaaaggtgcaacgggaatacgatcttccgtcgggagattttccttatgtggagcacttcaaagaggtcttgagcggttacagctttgacaagtttgagaaggtgaagcccaagatgatacaggccgtggatgatatgcttggatatgacattcctgaacttctcaagaacttcagaaacccatacgagtgaacccatacaggcggttgaaagatgacttcgatctgcaacagaatgagggattgattgtcaggcgatgtgaatcatagtggtcaatgtctcttggggcgttcattgccatccatgcttagccattgntatataactttatgcataagaatcatagagccattgctcaagctttcaccagacatctgattatgtaaaatccacaaaatagtaat

SEQ ID NO: 78522 - DNA, 368 bp, Zea mays
  Clone ID: LIB3088-049-Q1-K1-G3
cgcaaaaccacaaccgcgcggttttctccctcccccggctcccgcggcgcaagcgcagccgacccaagcgccatggccgccgccgcccccgacgcagacgcctacgatatcccgtgggtggagaagtaccgccccgcccgcgtcgctgacgtcgtcggaaactccgatgccgtcgcccgcctggaggtcattgcccgcgacggcaacatgcccaacctcatcctctccgggcctccggggactgggaagacgacgagcatcctggcgctggcgcatgagctcctcgggcccagctatcgtgatgccgtgctggagctcaatgcctcagatgacaggggtttggatgttgtgcggaacaagatcaagat

SEQ ID NO: 78523 - DNA, 169 bp, Zea mays
  Clone ID: LIB3088-049-Q1-K1-G4
aaaaaacataaaaaaaataaaaaaaataatttaaactgttaaaacacaaaaaaaaaatcaagagaaacggtcaaatataaaactgatttaagacaaatatataaagggcgtccattattcaaaatacttgctgtctaacaacagcatgaaacttgatgaccctagttta

SEQ ID NO: 78524 - DNA, 367 bp, Zea mays
  Clone ID: LIB3088-049-Q1-K1-G7
atgcgttctttcttccagcacatctgccatactagtattatcagcaattgtccatcgcagcgcatatgtctttctcatcgtgaatggaggtgggtatagtaccagacaacatggcaacaacagacatgccaagctccggtatcctgctgacgcctgctggggccatcagcctgttctcgtcgggtccttcgctccagatgccgcttcacttggcctccatggacagggatgctagggtgctgaggtacagggagaagaagaagaacacgaagtttgacaagaccatacggtatgccacgaggaagacgtacgcagaagcacggccgaagatcaagggacactttctgaaaagatcgtctgatattga

SEQ ID NO: 78525 - DNA, 373 bp, Zea mays
  Clone ID: LIB3088-049-Q1-K1-G8
gccgctgctacgacttctggctggagttcagcgagtgcatgagccgctgccgccagcccgccgactgcggcctcctccgcgaggactatctcgagtgcctccaccactccaaggagttccagcgcaggaacaggatctacaaggaggagcaacgtcagatcagagctgctgctcgtaaggccaaggaggaagctgagggtgcccctgctgttgcagcacaccattagtctccctgtctattttttgtgttgttgttttctgttaactcatctttggttcagttatgatgctaagggcaaggcaataatctccagctgttggactacacagatttttttccccatgacttaaatatcaagactcattctgtgct

SEQ ID NO: 78526 - DNA, 249 bp, Zea mays
  Clone ID: LIB3088-049-Q1-K1-H1
cccacgcgttcggatacgcgttcggacactcgtccgagcacgcgtgcgaaaaagaataaagaataaacagataaagacagaagataaaaaaaaataaagaaagtgaaaaataaataaaaaaaatgggtggcagctatataggttggagaatgatgttaggacatagcagttatagaggttcaatttagtaaaacatatataaaatgcagtgactgtagctgttaacagtctgattgggtaaataatgga

SEQ ID NO: 78527 - DNA, 77 bp, Zea mays
  Clone ID: LIB3088-049-Q1-K1-H3
gttttgaacaagttaaatgcccaagacattttgttttgttccattccagctcaagaattgaaagctaagcattgcac

SEQ ID NO: 78528 - DNA, 424 bp, Zea mays
  Clone ID: LIB3088-049-Q1-K1-H4
ggaacgaccgcacgcgttcgcggacgcgtggggtggcgccttaggcacgtagccaaacaggcctaaatcctctacatcctggtgccatggatatgagtcatatgacttgtacatataatcctgtttattctatattctatggaaaatgcttatttaacttgttaacaatgtaattatgcttatgatatttggatgatgatattgctcttgtttattaccatttttattagttatccaacttttaactcttgtaagttccatccgtcttgtatgggaatgaccattgagcaagcaaaacagatagatcattacatgtgctcggattgtgctaaagtaaatggtgcaaagtgaccctcaaattcatactgaatttcaccaaactcagattctaagattgaatcaaatatgctcatgagataaatgc

SEQ ID NO: 78529 - DNA, 435 bp, Zea mays
  unsure at all n locations
  Clone ID: LIB3088-049-Q1-K1-H5
catgacatgtacatgaaggtcaagggtaatatgtttaagaacaagagggtacttatggagagtatccacaagtccaaggctgagaaggccagagagaagacactttcagatcagtttgaggccaagcgtgcaaagagcaaggcaagccgtgagaggaagattgctaggagggaggaaaggctggcccagggcccaagagaaccaacagcacctgtcgcagccccagctccatctactggggtgccaaagaaagcaaagaagtgaagtatggaaacaaagctgtagctttttggtactatataagcatgactttggagcacctgaagtattttgctgntctataggttcgtgtctcaatattctgagtcttgtatctctaccggtctgttggataatgcatgccgtaagagttgtttatggagctcttggtgttac

SEQ ID NO: 78530 - DNA, 455 bp, Zea mays
  Clone ID: LIB3088-049-Q1-K1-H6
ccgctatctcgcacgtcgctccccaaatcatcccatcctacgcccgcggccgtggcaccgaatccagaagcgtctagaagggggaggtggtcgcccatgaccgtctgaccggccgtcgccatgggatgcgctggatccactccaaagactgacgataatggtaagaatttgaagaaaccaaagccttggaagcacacccaagcaataacgccggcacaactcagacagatgcgtgatgaattttgggacactgctcctcactatggtggacagaaagagatttgggacgcacttagagccgctgcagactctgacctagcgcttgcgcaaaccatagtggatagtgctggcatcatcgtatcgaattctgacatgacactttgctacgatgaaagaggtgccaaatatgagctttcaaagtacgttctaagcgagccaacaaacttgatcaagga

SEQ ID NO: 78531 - DNA, 79 bp, Zea mays
  Clone ID: LIB3088-049-Q1-K1-H7
gttttgaacaagttaaatgcccaagacattttgctttgttccattccagctcaagaatgcggagctaagcattgcacag

SEQ ID NO: 78532 - DNA, 460 bp, Zea mays
  Clone ID: LIB3088-049-Q1-K1-H8
gggctgatgaagctcatggaaggggagcacattgggccgttcaacctcggcaaccctggagaattcagcatgctggagctggctaaggtggtccaggacaccatcgacccagaggcgcacatcgagttccgtccgaacaccgcagatgatccgcacaagcgcaagcctgacatcagccgcgcgaaagagctcctcggctgggagcccaaggtccccctccgtgagggccttccccgcatggtcactgacttccgcaaacgtatcttcggggaccaggaagggtccaccgagtcagctggtggcctttcttaagtgctcaaaacttgttgaagtgacacgtttgtatggtatatgacttgatacagttttggcgctgtgctctatacgtagttgttatatagggatataaatgtttgttaaagtacggaaaatagcctggcacgctatactatgtaacgac

SEQ ID NO: 78533 - DNA, 435 bp, Zea mays
  unsure at all n locations
  Clone ID: LIB3088-050-Q1-K1-A1
cccacgcgtccgcggacgcgtgggtgctcatcacctacctgcagcacacccacccgtcggtcccccactacgactcgagcgagtgggactggctgcgcggcgcgctggccaccatggaccgcgactacggcatcctcaaccgcgtgttccacaacatcacggacacgcacgtcgcgcaccacctcttctccaccatgccgcactaccacgccatggaggccaccaaggcgatcaggcccatcctcggcgactactaccacttcgacccgacccctgtcgccaaggcgacctggcgcgaggccggggaatgcatctacgtcgagcccgaggaccgcaagggcgtcttctggtacaacaagaagttctagccgccgncgctcgcagagctgaggacgctaccgtaggaatgggagcagaaacccagaggaggagacg

SEQ ID NO: 78534 - DNA, 344 bp, Zea mays
  Clone ID: LIB3088-049-Q1-K1-F5
gccactcgtacgggcacaaggatctcctgtacggtgatctatagctgaagcagcgtcttgggctgcgggatgcgttcatcaccagcctggacgactgccaggcctacaccctgaaccggatccacgacccggactaccatgtcgagctgtgcacagagctcatcaactagatcatggactcgaccaaggctgcggaggtgctcgctaagctgaactatggaagcgaattcgcacacacgctggtggacaccctgatcctgaccatgaacggcataccaaacagccttcaaaacaccggttaaaccactaagaggtgatcttgattattctcctgatcattggct

SEQ ID NO: 78535 - DNA, 371 bp, Zea mays
  Clone ID: LIB3088-049-Q1-K1-D2
cccacgcgtccggtggctagatcatttgcacggccgttcggttcataaatcacaaaccttcggcgaagacacggtggggccttgagttctggtggagtgtgcttgtgcgtgtcgctcgaagcccgtacatcattggatcaggtcatgccggttgtgcggtcacgctggatgtcagaagcaacctagcttaaacctcattcgtgtacatgtaaaaggatcccccctacagtatagttaaaaccagcggagattcatcgcgtgatatgtggagagatgagttccattgattaatttatttatactagttgagattctggccctgtatcgtacgtatatcattggttttgtattagttggtcaatagaatttct

SEQ ID NO: 78536 - DNA, 293 bp, Zea mays
  Clone ID: LIB3088-049-Q1-K1-D3
cccacgcgtccggttatgtgattgtgagttagatgtgctatgtgaaaaaaactaaaaaggggaccacacaaaaagagaagcgaaaaaaagaacatgactaactacgcataaacaaaagccaagcactacaacgccagacagccccctataatgaagtgagaaatgaaacgagcaatcactagatccttacgatcccaggaaccactctaaatgtaccagccgagacctacagaactaccagccaacaagccaaccacgccctcctactaggatattatctatccctactttcc

SEQ ID NO: 78537 - DNA, 405 bp, Zea mays
  unsure at all n locations
  Clone ID: LIB3088-049-Q1-K1-D5
gcctgcccgacggcccaccatgatcatcctcaagaagaaccgcaatgagatctgcaagtacctcttcggggagggcgtgctgtatgccaagaaggactacaacctggcgaagcacccacagattgatgtgcccaacctccaggtgatcaagctcatgcagagcttcaagtccaaggagtatgtcagagagaccttctcctggcagtactactactggtacctcaccaacgatggcattgagcacctacgcaactacctgaacctnccgtctgagattgtgcctgccacgctcaagaagtctgccaggccactgggccgtccatttggctctggccctcctggtgaccgnccaaggggccctggtcgttttgaagacagaccaaagtttggagacagggatgagta

SEQ ID NO: 78538 - DNA, 393 bp, Zea mays
  Clone ID: LIB3088-049-Q1-K1-D6
tgctgacttccgcttccctacaacaaaccttacaaggcattgttttactcgctatgtcgagtaccacaggtgtttgaatgccaaaggggatgatgctggtgtttgcgaaaaatttgccaagtactacaggtccctttgccctggagaatgggttgagaaatggaacgagcagagggagaacgggacgtttccaggacctctctgaatgtaccgtccgagaccttcagttggaccagtcaacaagttggccaggcagtcctactgttccattctgcattcctacttcccgaatcgtaaatgccttttgtcccttgctcttcaaccagtcaccacaaaactgttagtgatgcctttcgtacgcagctctaataatttggctacagatgccccaca

SEQ ID NO: 78539 - DNA, 452 bp, Zea mays
  Clone ID: LIB3088-049-Q1-K1-D8
cccacgcgtccgggaatactggagacctgttggtcatgtttggtacatattgtctcatgagtcataacacgagcatccgaatcagtgttatgtggtaagaacggtctgccctaaatcatgatgtgctccatatggaaaaggctgaaagaagttgcctcatgctgcattattgtgtaaagtgagcaaccatttctatctcattaaccgctctgctcttaacaagtgaaattaattttggttcttgataaatacttgattttgaagggcaggctggtttagtgatgagagttgtttcactaagtcaccggatcgtaagttcgaagcaacatctctgcatttgcagaggaaggctggtattgatttattctttttctaggtcccacacacgtgggagtctctggcactaggtcttgccccttttataaatacttgattttgtattaacagctttt

SEQ ID NO: 78540 - DNA, 456 bp, Zea mays
  Clone ID: LIB3088-049-Q1-K1-E1
gcgggcaccagatgtgctcggcgtgcacgctggcgctgtgctgccacgccaagcccaacgcggcgacgcagtcccagccgctgccgacctgcccgttctgccgcggcggcatcgcgcggctggtggtggcgacgcggacgagggctggccacgacgacgagcgggacaagctggagtcgcccaggcaccgccggtcccgtcggtccatgaacctcagcggcgacgcgggcagcaccagcagcacactcatgggcagcatcgcctcgtccatcggcaagatgggccgccggcgaacagatagcagcgagcaggtcgacgacaagccgtagcagaatcctttcatgcacccgtccattcataatccacgtgaaatcttgcgccgtcgtggccgtcggcattccattccttcaggaacgaacaagccggtgtgttttgagattatttttggcaaatgag

SEQ ID NO: 78541 - DNA, 419 bp, Zea mays
  Clone ID: LIB3088-049-Q1-K1-E4
cccacgcgtccggatcacactcgtagagtgaaggaataatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgtccccggtgtgctctccatggccaacgccgggcccaacaccaacggcttcc

SEQ ID NO: 78542 - DNA, 415 bp, Zea mays
  unsure at all n locations
  Clone ID: LIB3088-049-Q1-K1-E5
ccacaacacgctcctcacctcgcggcgactcttgccaagcattcctccgcgaaaaacgcatccgctcgaaggggagttgatcgagaagcgttggtggacatgggtcagatccagtactccgagaagtacttcgacgacacctacgagtacaggcacgtcgtcctcccgccagaggtcgccaagctcctccccaagaaccgcctcctctccgagaacgagtggcgcgcgatcggagtgcagcagagccgcgggtgggtgcactacgcgatccaccgnccggagccgcacatcatgctgttccgccgcccgatcaactaccagcagcagcaggaggcggctgccgcgcagatgctggccaagtgagcccctggtggccaaggcggcgaccaggaacggttaaaaccctaaccccctt

SEQ ID NO: 78543 - DNA, 347 bp, Zea mays
  Clone ID: LIB3088-049-Q1-K1-E6
gaattacccgggctcgactccactgcgtctcgtgcccagctggcaacctgagcaatgtctatgttattatctctctaccgttcatattttattgtgtcgctggtttaagttaacaaaatgaccgacataatatatcatagaaccggactccaagagactcctattagcagctggcttcctttgtaaatgcacggttagagaccgatcgattctgacagtgcttgattactttacggagggattatcgaacggtacgaaatgttgtctcaaagtacttagtaatgatgtagtcatagtcttgatgaccagtatacattctgctttgaacatcgtctagtctattaaca

SEQ ID NO: 78544 - DNA, 237 bp, Zea mays
  Clone ID: LIB3088-049-Q1-K1-E7
ccagctcgtaagggggcttcagcggctaagcgctttccttaggccccagctaagcttggagcagtctggtacatgctcctgcttgcttatccatgaaataatgcctggacagtctgtagatgttgcgaaaacatggtgccccctgtggttgccgcgtgtgtagtaagtatctctcagtcgtagtgtggttgaagcatctgaactcttgagcggtttgcctgtgatggcatatgggtc

SEQ ID NO: 78545 - DNA, 392 bp, Zea mays
  Clone ID: LIB3088-049-Q1-K1-E8
agtgtagtactagctagccagtttgcctgttcactagccactagccaatttgcgacttggcaatgcaaatcaagaaatcgacgggcaaatatttttctcctgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaggggggcccgttttaagaacccaatgttaccatccttggcatgctacttcataacctttatatagggccacctaaatataatttacttgcccctttttaaaaaacgtgaaactggaaaaaccctggctttacccaatttaatcccctttaaagaaaatcccttt

SEQ ID NO: 78546 - DNA, 283 bp, Zea mays
  Clone ID: LIB3088-049-Q1-K1-F1
gatcgatcgatctgtggtgatgagtgtccttatctgtgtgtttgtgtttagttccagtcgtctgtgaggaagtcagttatgtttgagtgagaggggtacttcgctcttcggtgaacactgtacttgtcatgaggagagttttcatacccggagtgtaggaactctgtactgtactcggatccttcctttttcatcgaagtgggttttattttatcaaaacaaactcaaaaaagaagcacttaaaacatccaaaagacatatagcttgttgaatcattgaactt

SEQ ID NO: 78547 - DNA, 439 bp, Zea mays
  Clone ID: LIB3088-049-Q1-K1-F2
gtccctaatggtgcaaagtgcagcattgatgctttgttggagcgaacaattaagcacatgctgtttctacaaagtgtaaacaaatatgcagagaaaattaagcaagctgatgaaccaaagataatcgacaaagggagcggtgttatcttgaaagacaacccagttgctggcacaaatggtggtgccacgtgggcctacgaggttgctggccaaactatggtttgcccaataatcattgaggatctttcaccacctggtcagatgcttgttgagatgctttgcgaggaacaagggctctttctggagatagctgacaacatacgtggaattggtctgacggtcttgaaaggacggatggagctctgtgatggcaagatatggtcgcggtttcttgtcgaggcaaacagagaggtcacaaggatggatatatttctgtcgc

SEQ ID NO: 78548 - DNA, 365 bp, Zea mays
  Clone ID: LIB3088-049-Q1-K1-F3
aaaaaaaaaaaaaaaaaaaaaaaaaaaaattataaaaaaaaaaaaaaaaaaaaaaaaaaaagagcaaaaaaaaaaaaaaaaaaaaaaaaaaaaaaaacaaaaaaaaaaaaaaaaaaaaaataaaaaaaaaacacataaataaaatataaaaaaacaaaaataaaaaaaaggatagactgtaaaaaccctcacaatacctaactcaattaatcttgaataaaataccctttatgctatctaccataataacaaaaaggtccttactttaaaaccctttccaacatttaaatcattctgaattactaattaaactcactttgaaacaaatcattatatccaacagtttcatatattacaaacaattt

SEQ ID NO: 78549 - DNA, 370 bp, Zea mays
  Clone ID: LIB3088-049-Q1-K1-D1
gccttctacatggacggccacttcatcaacgacggcgggctgtaccggctcggctagccgccggtatctcgcttccatttcacaccccacggcctagctataaagactaatggttccaggtgtctgaagtactgaagacaggggggctagctatctaatgttcgtgccgcacgcatgagctgtaaggaggccatgcttaattattctgttgccgctgctactctatctatatgcgcctatgcctccgtgcatgaactatgctttaggtggttgctgctccacactgtggtggtgtgcttttgcttttgtgtggtcgtattgtatgcgtaacctgacagatggatccctgattgctacatgtttgaataat

SEQ ID NO: 78550 - DNA, 449 bp, Zea mays
  Clone ID: LIB3088-049-Q1-K1-A8
cccacgcgtccgcggacgcgtgtgagcggttcttggtgaggaacattgttgagcaggctgccgtgagagatgtgcaggaggcctgtgtacatgatggatatgttctacccaaattgtatgcaaaggttcatcactgtgtctcatgcgcaatccatgcgcacattgtccgtgtccgctctcgtgagaacaggaggaaccgtgagcccccgcagcgcttcagacgccgggatgatggcccaaggcctggtcagggcccgccgcgcccaggcggtgcagctcctgcagctgcagctgctgctgctcctcgtacctaagttctggaattagtttcggggcttagttttgtgaaacattacctgttttgagaaaccattgttactgtatccccttgatgtcaaactttttagcacaatttgtggttctgaaaaagttggttgaatgttgcagct

SEQ ID NO: 78551 - DNA, 415 bp, Zea mays
  Clone ID: LIB3088-049-Q1-K1-B1
ggagattgggcggctgcagcagctctaatgctgaccttaacagcagcaagtttgaggacggctacagttagccaatatgttgtctgtctatgtcctcgcgaagtactagagcagtagctacataccgtggtttgtccatatcctgttgttagatgatcaagggtgattagatacatgttctggaaccaatgttcagatgacaaattgcaaactaaacacccttttgctctctatctttattttttttttgcaattgcaatgcgtgtaaagtacattatcaatgtcagccccaggcatatcaataaaaaaaaaaatgaacacacaaaaaaaagaaatataaaaaaacatttagaacaaaagggaaagagacctattgcgatctgcaccaaaaacaaaaagcattaacattgaagct

SEQ ID NO: 78552 - DNA, 427 bp, Zea mays
  Clone ID: LIB3088-049-Q1-K1-B2
cggacgcgtgggtccgaaagagagtattttgctgttccaaggaatttgaagctgcttgctgttccgcgctttgaactctacgataatattcagcgatatgggcctgtcatctccaccatcccgcagcagctttctaggttccagttcaacatggtgagctcttagaaggtgtccagcagtttactcatatagtcatccaaaacattgtttttgtactatagactgcactgttcgcagagtggagtttaaatatagctatgtggatgagtaagctgctgagatagacgtagggtgatgacacaagaagatagtgtggccaagacagctgttttgttgacttccgttgagatggatcttcaacatgctgagctagctgatcaacgtgccttgactggttttatttcattgtgctggattttttttatct

SEQ ID NO: 78553 - DNA, 244 bp, Zea mays
  Clone ID: LIB3088-049-Q1-K1-B3
agagaaagctcagggagccactgatccatttggtcagcttcgccagtgatcaagcattcgggtgattgaccctgatgacctgctggtatagtcgctagggaggagcgaactaagcgagagcgatcccacatttgatcagaggatgtgggtagagacattcaggggattatagacctggtccttgacaagggacgagattacatattggaacgtaaacagcatttggctacagatctatcacgat

SEQ ID NO: 78554 - DNA, 260 bp, Zea mays
  Clone ID: LIB3088-049-Q1-K1-B4
gccagtcatacgaccgatccctagtcgattcgtgcctttccacacggatatgctcacacgggcccgtgaaggtttgatccaggccgagcggaccgcggtggcggcggcggatatagcttgcacaaaagacgagatcacatacaatgaaccactggatctgatacgactcagtctcgacgagcgcatctacgtaaatctacgactctaccgccagctgcgcgacaagcctcatgcgaatgatcaacatttaaacatgatac

SEQ ID NO: 78555 - DNA, 401 bp, Zea mays
  Clone ID: LIB3088-049-Q1-K1-B5
cccacgcgtccgcccacgcgtccgcccacgcgtccggttcgattcgcttctgctgcagctagggtttagaggttttctgggcgcggagcggacggcggcggcggcggcggctatggctgcggcggaggaggagatcgcggtgaaggagccgctggatctgatacgcctcagcctcgacgagcgcatctacgtcaagctccgatccgaccgcgagctgcgcggcaagctccatgcgtatgatcaacatttaaacatgatacttggagatgttgaagaggtcgtgacaactgttgagatagatgatgaaacatatgaagaaattgtgcgcaccacgaaacgcactatccccttcctttttgtccgaagtgatggtgtcatattggtttcttcaacccttcgta

SEQ ID NO: 78556 - DNA, 339 bp, Zea mays
  unsure at all n locations
  Clone ID: LIB3088-049-Q1-K1-B8
gngtcatcactcgtcatggcgtcggtgattcggtttcgggtgacagggaaggacaagatggtgcggtggtgcgccgggaagcaacacttgctcgccaagaagaacaccaagcgcaagaagagactctccaagatgctatttttgactgcttcaacgggggcgatgtcggtgaggccgaggcgggagaggccaagtcctgccgggccacacccggacccgagctccacggcccgagttcccgggaagcggggcacgtcggcaaaggggagggccgggtcgcggatgcagcgctcgacgaacttgacgaggaccagggacgagggccacacagaggtgccc

SEQ ID NO: 78557 - DNA, 421 bp, Zea mays
  Clone ID: LIB3088-049-Q1-K1-C1
cccacgcgtccggccaaccgttggatacatcgctcatgaggccatggtctagaaggactagagcgtaaaggcagctggcgtgtggacatgcggcgcgaccaactacgtgacgcttgagatcaccatcattcatagagactacgatgcatacatcgtgaagaacctcatagatggcctagacaatgacaacagtactaataaggagatcgacgagcctgaacaacacgaccatagcaagagacagatcatgcagaaggatttgatctacgagaacattacatcgaaaggttcacatagacctcaagcagccatagaaggcaacatacgacctgagcattacaaggatgacctagactaaaataccgatctttaccaaccaagattgaatggacaaaatgtatgctattggacaacattgaat

SEQ ID NO: 78558 - DNA, 451 bp, Zea mays
  unsure at all n locations
  Clone ID: LIB3088-049-Q1-K1-C2
accactcttggcgaagcgaaatccaccgtacaccgctgcctccctctccctgtctcgtctcgtcgaaccagccgaggaagccaacgcagacccagcgatcctcgtcgcgcgtcctccactcctcccccacggagggaaggatggcggagcccaaagcggcggcggcgaggaagacgcgggtgggcccgtacgaggtcggcaagaccatcggcgagggcagcttcgccaaggtcaagcacgcgcgcgactcccgcaccggcgccgtccgcgccatcaaggtgctcgaccgcaaccacgttctncgncacaggatggtcgagcaggtctgtccgtccgtgatccgtcccttccgncttcccttcgccggccgctggggaacatatgtaatgtaacctccgggaaaatttttaaatataccggagctgccatagaaagaacggcttcgcgaatc

SEQ ID NO: 78559 - DNA, 189 bp, Zea mays
  unsure at all n locations
  Clone ID: LIB3088-049-Q1-K1-C4
cctacgcgtccgtctttgccctcttgtgagttccaagaagattagagaggagatgatgggcgtcctcaggaagatgagagcggctggtacgcacactgacaagaagaaataaagcatttcaagttcatgaatgtgtnnganngagtagatgntcttctattgcccaatatatatacgaccatcagtctt

SEQ ID NO: 78560 - DNA, 407 bp, Zea mays
  Clone ID: LIB3088-049-Q1-K1-C5
aacgagggtgctgatggagagcatccacatgtccaattctgagaaggccagggagaagacgctctcggatcagttcgaggccaggcgcgccaagagcaaggcgagtcgcgagaggaagaatgctaggagggaagagaggctggcccagggcccaagagaaataccaccaccagtctcagccacagctcccactaccggggcaccgaataaagcaaagaagtgaagtattgcaacaaagctgcagcttactagtccagtacttcgtaattttggagcgccctgatcaattttgctgttatacagcttcgtgtcttttattttccaaaagctaccgtacctggattggtagagatgtttacgcagagtttctttggaagaagatccgctcaaaaaagtttatttggatc

SEQ ID NO: 78561 - DNA, 445 bp, Zea mays
  Clone ID: LIB3088-049-Q1-K1-C7
cctacgcgtccgcaaaactgagcgacaagttctctgaatctgaactgataagaatggtcttagttgggctagcatgtacgcattcagaatctgaaaaaagaccaacaatgcttgaagttgtgcccttgctgaaaggcgaatcaaaagaaacccttcttaagcttgaaagagatgagttgttcagctcagactcgatggtgagttcacaaggaacaccaaccccagatgggggcacagactctgtgccaaaggaagatcaagaacttgttggagcgtgaaatgtgatatgttgctactgtaggcgatggtagaatgcggatttgtgttattggttgatgtttggtttgtgcggtttgacatgaatgtaaattgtataggcattggtttctgtaaagaagtatttacccattccttttgagagattaaagaagagcatgggggctgg

SEQ ID NO: 78562 - DNA, 420 bp, Zea mays
  Clone ID: LIB3088-049-Q1-K1-A6
atctggtcaaagtggtggtggacaccagatggacaggggcaatcagggttaccgcggaggctatggtggcgtttcaaggtttcaggatgcaaggggtcgcaaccagtctattccatcaggcagaggtggtgatggtggtgcacgcatggtgaatctgaacaggattggtagggtttagaagtgataattttcagctcgagtaagcctgaaattctcctaaaagccaagttttgaatcactggtttttacatagtttcctgttctgggctgagccatccacctgtttactacatttcgttgtagccttttaatttaaggggctaggaaattgaactaagagtttggtactgtgaactaagagtttggtactgtttcctgggagtgtgacttcactccaatatttgatatctatctgtgaca

SEQ ID NO: 78563 - DNA, 204 bp, Zea mays
  unsure at all n locations
  Clone ID: LIB3088-027-Q1-K1-C11
ggggaataactgaaacatcaagatggtgtttgcttcggagttttctaagagggggtggggctaaacaaaantcatntattatgctatgcattcanaagatgatgctaaactgaataagcacatcaatcggatttttctatgcacttttactatgtttgtattatagaaatgcaatgcaatctatgcactaaaacgttcaactct

SEQ ID NO: 78564 - DNA, 381 bp, Zea mays
  unsure at all n locations
  Clone ID: LIB3088-027-Q1-K1-C12
cccacgcgtccgcagaattcctcaccggcctgcctcagagagagaaaaagcggagattagcggcggctatggcactgccggcgtcgagctccggcctcttccgcttcgtctccccgcgcagccgcccccagtccaccgacatcgtggctgccgcctcctggggagtcttcgccggcaccgccggcctctacctcgtccagccatttgactggattaagaaaactttcttcgagaaaccccaaccagaagcataaaaagcttgccaggcttcaactttggtacttcacttttattccggatgggtcctgactgaagagaacttggattacttaaccaattataccagaccccctcgnggttccctggttggttttttattat

SEQ ID NO: 78565 - DNA, 409 bp, Zea mays
  unsure at all n locations
  Clone ID: LIB3088-027-Q1-K1-D1
accggnnccggaanttccccgggtgcgagccgcacgcgtaacagcggacgccccgtgggcggaccgcccgtggggaagaaaccctgaaacccatcaagaatnnngtgtttggcttcggtacagtgtttacctattggaggagtagtgagtgcgtgaaannctgaagnntcatgtnnattatgnnctatgcnnattcagaagaatgnaatgctaaactnnngaataagcnnacatcaagtcgtgagtttttctaatgcccactgagactatnnngtttgtattaattggttatgcccaatgcaatctaaatgcactannaaacgttcaacttcttaaaaaannaaaaaaaaaagggggcggccgcttcttagaaggatcnncaagnncttacgtacccgcgtgnncatgc

SEQ ID NO: 78566 - DNA, 210 bp, Zea mays
  Clone ID: LIB3088-027-Q1-K1-D12
tcattaacagtctgtctcaacttgtaccaacgcacatcagcctgaaaagtactttcacatctaccattccgatagactcaaagccttcggacctatatctgtgtctctcaaccgtgccaaccataatcaacaggtcattgtattctcttgtatcaggcaaattttaatataatatatgactgtgttaaatattattatagactctccttc

SEQ ID NO: 78567 - DNA, 426 bp, Zea mays
  unsure at all n locations
  Clone ID: LIB3088-027-Q1-K1-D2
acatacacccactcctccgcattcacacctgccgttctaaacaccaatgcaacatctacccngccgcagcgttttaaaaaagggaggcctaaacacactaacacactacaacaatgctccccaaacagctgtatgccaaccaaaacaatatttgtcaaggctgaacataaacctttttctttagcatggagcaaccaaaccctgtatttctctgtacaaacctaattgcctaaccttttccatttccatccatttttgcttctattttatacccaacatctccagcaaaagaatgctttatttccaattacctttttcatctccccttcaccttatccattttcttacattaccctcttactcctaagaactcttttccgcaccattttacatttcattttaattacttttggatccttttattcc

SEQ ID NO: 78568 - DNA, 163 bp, Zea mays
  unsure at all n locations
  Clone ID: LIB3088-027-Q1-K1-D3
acatacacccactcgtccgcatacacgtgggaatttttataacaccaaaacaacatctacaccacccgcggtttttaaaaaaaaggtggcctaaaaacactcnccctctataacaattccaaccttacatcctcgtgcctcccacaacataacttttctatgc

SEQ ID NO: 78569 - DNA, 192 bp, Zea mays
  Clone ID: LIB3088-027-Q1-K1-D4
acaaaccgaattgcctaaccgtttccatttccatgcatttttgcttctattttatacccaacatctccagcaaaaaaaggctgtagggccaatgactttgttcagcgccgctggaccttatccattttcttacattcgcctcgtactcgtaagaactcttggtggcaccatgtgacattccatgtaaattac

SEQ ID NO: 78570 - DNA, 178 bp, Zea mays
  Clone ID: LIB3088-027-Q1-K1-D5
aaccaaaacaagatttgcaaggctgagctaacgccctctttttatcattgaacagccaaacacaatgtttctctgtacaaacccaattgcctaaccgtttccatttccatgcatttttgcttctatttatacccaacatctccaacaaaaaaaggctttagggccaattacttttttc

SEQ ID NO: 78571 - DNA, 375 bp, Zea mays
  Clone ID: LIB3088-027-Q1-K1-D7
acggacattcctcccgtgcagcaaaggctcatctatgctggtaagcagcttgctgatgacaagagcgcagaggactacaacatcgagggtggatctgtcctccatcttgtccttgctctgaggggtggttactagtctaaacctgatgaactagcagtcagataaactgttgtgtttgctgcgaaatgtgcaggcctgatgttgaacttgcaaggagataataacaaattatcagctttgcgcctgtgcccagtggaaggggctgtcttccaagttattgtctgatatggaattgttccagattatcatgtctcggcgtttacccattattattatttgatttgaaccttactgtgttagtcagttttcatactt

SEQ ID NO: 78572 - DNA, 398 bp, Zea mays
  Clone ID: LIB3088-027-Q1-K1-D8
acgacaacgcttccgcgaacccatgggtttatcaattttaaccctagcgcgcgccacaacacctggggggtgttactacaacgtaccgggcttgctttcccgtcacctaaatgacgaaccgcaccaagaaggctggaattgttggcaaatattgaaccaggtatggcgctagctttcgtaagcaaatcaagaagatcgaggtatctcaccactccaagtacttctgcgagttttgtgggaagtctgcttgcacaaggaaagcagctggaattctaggatgcaaggactgtggaaaggtcaaggctagcagtgcttacaccattaacactgctagtacagtcacttgcaccagcacgattcgtcgctgagagagcttactgaaacatgatttagcttgc

SEQ ID NO: 78573 - DNA, 103 bp, Zea mays
  unsure at all n locations
  Clone ID: LIB3088-027-Q1-K1-E10
cactcttccntcctctcaaaacagttcgtttactaagaccctgttctacccccggggctgttttttatgaaaggacgctcgctcaaatactnctntcttctat

SEQ ID NO: 78574 - DNA, 325 bp, Zea mays
  Clone ID: LIB3088-027-Q1-K1-E12
acgaaaccacatgtgttcaagagcccgaattccaacacgtatgtcatattccactaagctgagagcgaggacctgagcgggcagcgtgcagacccaggcaacaaaccaattcaaggcttctgactcgacccaaacgatctcaaatccacacacgtgtggcccgggacagtaagacaatgatgaggaggtctactaaactgctgttgaagccaacgacattaagctagcgatcacccatgcatgtcattcaaggtccaaagctgccaaggccctcaaggatcataactgtgacattggcactagcatcatggatctgacaacctaa

SEQ ID NO: 78575 - DNA, 309 bp, Zea mays
  Clone ID: LIB3088-027-Q1-K1-E6
aaccagttgaatcgtaaaggacttcaggcaagtgtttctcaccattttttatttcccccccaaagaatatatatgagagctgtgtatctaaggtagaaaataattaggctttagaacacaagctgctgtagtttttgtcagttctcaccatcttttcaggaacatcatattcagcaaaccaaaatcacgtctcaaacctcattgtcacacttaatcatgttcttcttagtcctaagtttcacttctgttttttaatctcatgattaaatatgaacaaactgaattgttgcaacatggtattttaaaatt

SEQ ID NO: 78576 - DNA, 436 bp, Zea mays
  Clone ID: LIB3088-027-Q1-K1-F1
acgcggacgcgtgggtgctagcaaaacagtgcgtggacgaagaccctgttctacggccggacatgagagcatgtggtaatcacgctctctcaaatactgctgtcttctatcgagtgggaggcaacacaggctgggaacagccaagtgtttagtggtcttgtggcggggaggtgatctggtcaacacaggctgctgtacatgctcttgagtgatctactcacctgatccaccggagacatattcgcctatggccctcctctttatatcttactggtcctttgtccagttgagcgattttcaggtttcttctgagctctgagagaatacctaccagagtgcaatatattttttggtgggtggtacagtatgtagcaacgtatgtatacaagaatctaccttgtgatgcaatgtcctgatgagtcatttcgtttgttcc

SEQ ID NO: 78577 - DNA, 459 bp, Zea mays
  Clone ID: LIB3088-027-Q1-K1-F11
gtttcgagtacgcagcagtgcagcaggtggcgtggactgaataagactttctgaagataccgtgcaatcactagtgcggattaccgaggcgctgttggggcgttgcttgtatatgacgtcactcgccactcaacctttgagaacgttgagcgttggctgaaggagctgagagaccacacagacccgaatatagttgttatgctggttggcaacaaatctgatctccgccatcttgtagcagttcaaaccgacgaaggaaaagcattcgcagagagggaatcgttgtacttcatggagacctctgcgcttgagtcgaccaacgttgagaatgcatttgcagaagtcctagctcagatctaccgtattgtgagcaagagagcagttgaagcaggtgaagatgcagcatctgggcctggcaggggcgagaagataaacataaaggatgacgtctcggcagtg

SEQ ID NO: 78578 - DNA, 323 bp, Zea mays
  unsure at all n locations
  Clone ID: LIB3088-027-Q1-K1-F12
acaatttcaagtcctcatcagtaccatagatcttttgaactgaatcaaactttctaaaggtgcggttttataactagggtgggtggccgaaactctntcttnncttcatttgtatatgacatcactcaccactcaacctttcagaactttgagcgttgtctgactgattttttataccacacaaacccaaatatacttcttatgctgtttggcatcatatcttatctaccacatctcgtatcagttcacacccacgaaggaaaaccattcgcagagagggaatcgttgtacttcatggagacctctgcgcttgagtcgaccaa

SEQ ID NO: 78579 - DNA, 279 bp, Zea mays
  Clone ID: LIB3088-027-Q1-K1-F4
cttgtcggaccctgtccatggtgccattgaggtctgctcctagctgaggcccaccgtcgacatctctgtgcctgccaacgccgactttgtgcgcccggagctccggcagtcttcctagattgaggcagtgagcggagagggagagggagagagaaagaaaggatttcgtgtcccgagttagaacagaatgctgtatgttttgtgcgactgtttgtaagtcaagtctgaactgtgaacctatgtttgcttctatcaaaagacccggaaaaagcctgggca

SEQ ID NO: 78580 - DNA, 136 bp, Zea mays
  unsure at all n locations
  Clone ID: LIB3088-027-Q1-K1-F7
ctggctcgcgctccncaactcctgccccgtctggcgccacgagatgcccgccgacaacgccgccccgcgcgctgacgccgacgacgccgcggacgaggacgccagggtcggcctcaccatctggaggctccccggc

SEQ ID NO: 78581 - DNA, 346 bp, Zea mays
  unsure at all n locations
  Clone ID: LIB3088-027-Q1-K1-F8
ttcctcccacccttccgttgacaatttgttgttgaaccattaacatccaatggcggagtcatttaataaacagctgggggagtaataacaggtccttgtatcaaatatcaatttaggttatgaagaaatagttaatactcaggttcttgctttcaatgcccactctgtaaaaaatttaaagaacttagcgaccatcgtggaaaatttcacggattaatttctgaagtntgatctgtactatgaccagattgttgtcctcgagactaaaacttgctagactgctatccacgacattctcacgacacactgtataccgtctgcattgtcagatgaccttaacgcctac

SEQ ID NO: 78582 - DNA, 230 bp, Zea mays
  unsure at all n locations
  Clone ID: LIB3088-027-Q1-K1-C10
acacggacgcntnnncngactcttggggaagaactgaaacatcaagatggtgtttgcttctgcagtttactattgagaagagtgggctaaactaaantcatgtattatgctatgcattcagaagatgatgctaaactgaataagcacatcaatctgatttttctatgcacttttactatgtttgtattatagatatgcaatgcaatctatgcactaaaacgttcaactct

SEQ ID NO: 78583 - DNA, 406 bp, Zea mays
  unsure at all n locations
  Clone ID: LIB3088-027-Q1-K1-G3
gcgagtacggttcaaactgaggtcgacatatatgctgtataaagacaactttgccttgtactatgtggtggtgttcttagcagtggtagcgcgtctaaaacatccttcaacatcncacaacattgtgaacagaatctgctgggccttctgtgtttatttggaggcagnnacaattaatctttatttgcgctngaaacaaaataccaagattgttgagccttttacagctcattattgtttttctcagtttttttcaaggcttttttttcgttcatatttagttcttttttttttttattttctttttatcttttctttatgttttcttttaattcttattatcttttatttttatactttttttattttttcttctcttattttacttttttttttaatcttttta

SEQ ID NO: 78584 - DNA, 83 bp, Zea mays
  Clone ID: LIB3088-027-Q1-K1-G9
attttaaactgtggtattgcaatgactaaagtatattatagtatttcaaaaaaaaaaaagggggagggaaaaaattttttttt

SEQ ID NO: 78585 - DNA, 338 bp, Zea mays
  Clone ID: LIB3088-026-Q1-K1-G11
cccacgcgtccgcagttggagtgagggatctgcttgtcaggtcatgaggaacatgcttgcaaatgagggtgtccggtcattctacaagggtttgtccgctggtttgctaaggcaagcaacgcacatagactgctcatcttggatccttcagctatggaatgtttgccaccagagggtgtgatagatttgtgaatgtgtgggatgacattaacaagagaatactatatcagtactcaaaagtgcgcatcaagcattgttgcactgtcattcggtaaggatggccatctgcttgctgtggcatccaactacacttatgaagagtgagaaaaaacgcactt

SEQ ID NO: 78586 - DNA, 306 bp, Zea mays
  Clone ID: LIB3088-026-Q1-K1-G12
tcattcgaagaaggtcccccaccaaatgctgcacttaataaggtgcctcctacccgtgccaaatcgccaatttttacaagttcaaggggaaagaacttcagtgatacaccattaacacctgtctgagaaaattccaatgcaacatttactcctccacatcgtcacattattcttagtcctaaagactctaacagagttcaacaattctctccaaataatcttttgtcaaccaaaacatgatttgtcaaagcttatcttaaagccctttgaatagcatttattattctatctctttattcttttttc

SEQ ID NO: 78587 - DNA, 175 bp, Zea mays
  Clone ID: LIB3088-026-Q1-K1-G2
cactcgtccgcggactcgtgggtgaatattcaaccgcataaaaaaataaaaaacaaaaactaaaaaaaggaaaaaataaaaaaataacagggccattttaaaacgagaccaagcggaacaaacacacacatgcaactaattaccaaaatctataagatcacctacattcaattca

SEQ ID NO: 78588 - DNA, 428 bp, Zea mays
  Clone ID: LIB3088-026-Q1-K1-G9
cccacgcgtccggatacccagattcctttgactggcccaaattcagttgttgggagaagatttgtggttcatgagcttgaagatgatttggggaaagggggccatgagctcagcctctctactggaaatgctggtggaagactggcatgtggtgttgttggcctgactccattgtatgttgctcgccttgtgcccgggttgcagttgcagctacgctgttacatccttgccttggtggacttttgtcttcaatcgtgttattggtacagttatactgttaccttttttgtattacttggattcattttatgcatgttggtattgtgctgttttatcctttgcatgtcttcctgattaaatggttattttttattttatgtaaattatttttttcactatttttctattatttttgttttatttttttt

SEQ ID NO: 78589 - DNA, 279 bp, Zea mays
  Clone ID: LIB3088-026-Q1-K1-H1
tccatgacacagcatacattaaagaggtcatacttaaaatttggttcgaattaatctagcactggactacagaatacttcaaacttggtcaaattgatatcgatgactctgtatactaactgatgaatactaaatcaatcctcaaggatatcaaagcgctgtatataaggtacgtaacaagctttgatgccactgtacaccatgtacatattgcaatgcttaccgtctaacagatccttaaactgaataaagattattatattattacagtagctacat

SEQ ID NO: 78590 - DNA, 172 bp, Zea mays
  Clone ID: LIB3088-026-Q1-K1-H10
ggaacttgcttggtgaagatcttgagtcattaggcataaaagagctggagcacctggagaagcagctcgatgcgtccttgaagcacataagatctacaaggacacaacacatggttgatcaactgacagaacttcagaaaaaggaacaaatgttttgtgaagcaaataagtg

SEQ ID NO: 78591 - DNA, 346 bp, Zea mays
  Clone ID: LIB3088-026-Q1-K1-H11
ctcgagctctactccatcccctcgatctcgaagcgcagcagcagcagtcaggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaagacaacaagaagacccgcatcattccgcgccacg

SEQ ID NO: 78592 - DNA, 399 bp, Zea mays
  Clone ID: LIB3088-026-Q1-K1-H12
gagaacataaagaacatgatattggagaacctgtcaaagatagaacatgttcccagcggtcaattccatgacagaccgtcagaccccgaagctccagaggagaaagaggaggacatggacaagaggccacctcagcgcagcagattatggagcggaggagcttacgactctgatacagaggatcctgacagcctgaaaagcgagggtaaagacgtaactgctaacttccagatgaaggatgaaccaaaagatgatctgtagaagtttcagaagtgcccccaaagttactgagttgtcaatgggatcgtcgacatgcatgttgaagagtggggacgcatctgaacctgtccgtgctgatatctgccgctgtgcatcttgtacagactgaacgttttgctg

SEQ ID NO: 78593 - DNA, 447 bp, Zea mays
  Clone ID: LIB3088-026-Q1-K1-H2
ccacgcgtccgggcttgtagctgccgattctgatgaggtaaaggtccatgagacagcattcaagaaaggggtcataccgaagctgtggttggaatggagcgagcactgtactacggaagacttcaaacttggtcaaattgatatcgatgactctggggacgaactgttggatactaaagcaatccgcaaggatatcaaagcgctgtatagaaggtaggtaacaagctttgtggccactggacaccatgtacatattgcagtgctgaccgtcgagctgatccttaaactgaagaaagaggtggcgggtgttgcggtggctacattgcgcggtaacaaaagaagtcattccaagctatatccgtggaatggcggcttcttttgttcctagtatgtgccaacttggggcagcagccagctgatccccagacacatttctagactcttttt

SEQ ID NO: 78594 - DNA, 185 bp, Zea mays
  Clone ID: LIB3088-026-Q1-K1-H3
atcactgtactacagaagacttcaaacttgctcaaatttatatcgatgactctgccgacgaactgatgtatactaaagcaatcctcaaggatatcaaaacgctctatacaatataagtaacaagctttgttaccacttcacaccatgtacatattgcactactcaccgtctaactgatccttaaa

SEQ ID NO: 78595 - DNA, 250 bp, Zea mays
  Clone ID: LIB3088-026-Q1-K1-H9
gttatacatcccgagccatcaatgtggactattccagcttacctccacgagcatgctggggcttagctaagagagggggttacttaatttcaagttattaaccttcttgacgcaactcccaacttgggaaaaccaaggccttcccgacctaaatttccaaacgttaaaccctcaattctccaagtggcacattaaaaacaatgcctgaccagttcggaatcaggaccaagggcccaaattaattggcaac

SEQ ID NO: 78596 - DNA, 342 bp, Zea mays
  unsure at all n locations
  Clone ID: LIB3088-027-Q1-K1-A12
gactcatacagctacacatccactttcttacacatcaactttactccctcatccatcattaccncatctggctcaatttcaaaaagctcgggtgctcaaaacacccccacacaaacaagcanccctcttaatacacaccacctcatctattcccccttaacaagccaaaatcgcacaatttttttcctagcctaaaccacaaccattataacccaacatcaaactctaataataaccttgatacttacaacatctacatcttcaaagttcttaaacttgtacacacctacattatcatcttctccaacgccatttccattattaacttcttcttctaccaca

SEQ ID NO: 78597 - DNA, 334 bp, Zea mays
  Clone ID: LIB3088-027-Q1-K1-A6
acggttatacatcgccatctaaaactagagacgtttattacaaagccatcaatacctaaccgatgagcaatttgatatgcgagcgtgctcacaaccaccaagggctacaagaactcacctgagaagacaccaactaacgagaactccgttaatagggcaacacccaacaattttataccctgcaagggagacccacataagaacgcaacgaaaaacgctaacaacagcgttgctacttacaagatctacatcttcaaggagctcaagcatgtgcactcatacataagcatctcgaccaaggccatgtgcatcatgaactccttcatcaacgaca

SEQ ID NO: 78598 - DNA, 457 bp, Zea mays
  Clone ID: LIB3088-027-Q1-K1-B10
ctaggggtccctgatacttctctcgaagcaagatacatcactcttcatgtgtgcgaccttggcgcatatagaggtgcacgcctggctgctgctggtatatatggtattctgaagaagctgggcaaagacaaattgcttggtgactttagccaacaaaggactgtagttgctattgacggtggcttatacgagcactacaagaagttcagtgcctgcctagaggcgacgctcacagacctgctcggcgaggaggttgcctcatcggttgttgtcaagttggccaacgacggctcaggaattggagctgcacttcttgctgcctcgcactcccagtatgctgaagctgcatagttctaggagctcgggggtcctagtgtaacctttttttttgtttcccaccatttcccccttcaatcgagaagcccccctcgtgcgattcgcatctctctattttctt

SEQ ID NO: 78599 - DNA, 470 bp, Zea mays
  unsure at all n locations
  Clone ID: LIB3088-027-Q1-K1-B11
gccgcacacgtacactcacgcttcctgacacttcactcgaatcattatacatcactcttcatgtgtgccaccgtcgcgcttatataagtgcgcgccggcctgcaaatcntatatattgtattctcaaaaagctgggcaaagacaaattgcttggtcactttagccagcaaaggactgtattttttattgacggtggcttatacaaacactacaagaatttcattgcctgcctagaggctacgctcacatacctgctctgcgaggaggttgcctcatcttttgttgtcaagtataccaacgacttctcatgaatttgatctgcacttcttgcttccttccactcccagtatgctgaagctgcatatttctagtatctcggttttcctactataccttttttttctttcccaccatttcccccttcatccaaagccccccttttgccacttcatctctctattttctttcct

SEQ ID NO: 78600 - DNA, 433 bp, Zea mays
  unsure at all n locations
  Clone ID: LIB3088-027-Q1-K1-B12
acaaaagctccccccgtcacctccctcgcccttttctcctccaccgtcgacgtttcccaccgcggcgtacttataaaggccggtgttcatgaaaacnatncatgatctgatccgcacagacttgcaacagtacatggcgagcgtgaccttgcgcgccggatgccgctcctttttcttggccgacctctacatgccccatctcgtcaactgcgtcattctctccacctcccagcgagtcacccggatgcagtagctcctgcgctttcatgagccatcaaatactctcccaaaccgtcaatcaatcttctatgactaactctcatcatcttttcttatcaatatcaaacttccaagttattattttcctttttttaaaactttattctctccaaccgctgttaaacctaaacagcagtaaaaagagtctcaactg

SEQ ID NO: 78601 - DNA, 165 bp, Zea mays
  unsure at all n locations
  Clone ID: LIB3088-027-Q1-K1-B2
aatcacaacaacacttncttacaattcttaatagcagcatcccaatatattttttttttttgctcccggaacaaaacaatatttttatcatattctttaaatcttttccatcttatcatacaactccaaattcctataaatcacatcatttcctaattttatcca

SEQ ID NO: 78602 - DNA, 394 bp, Zea mays
  unsure at all n locations
  Clone ID: LIB3088-027-Q1-K1-B7
acgatctgtgtgtgaccccngcgcattaccccatccgagaaattctggagaaggaaaanaangaggagagttttgctaaaacagaaggtaggccggagcctgcattatatggaagcgaggacatccgccctcttagcatagatgacttcaaatctgcccatgagcaggtttgtgctatcgtttcgtccgactcggcgaacatgaacgagctccttcaatggaacgacctgtacggtgaaggcgggtcaaggaagaagaaagcgctgagctacttcatgtgatggggtgagagtatagaatccagaaggatcacaaccgtggcataagatcagaagaaacacagccgtgccaccacatcggtacagcggccatagtaccacacccactatggccc

SEQ ID NO: 78603 - DNA, 380 bp, Zea mays
  Clone ID: LIB3088-027-Q1-K1-B8
acggcttgttaagttggccaagatgttttccaaaccgaagctacaaactgtctttctgataaacaggctattatttaacaattggcatgttgaaagaaacttgaactgaaggtgggaaagcacaacaacacttcgaggaggttcttaagagcaacatcgcaatatatgtggaaaagttgctcctggagcagttcaatagtttgatcagattcgtcaaatctcgtccagcggatgagacggctgcaaattccgagaaagccagcattgccgaagttgaaccactggtaaaagatttcgcgagccggtataaagccgcgatcgagctgatgcactatgatgtgatcacatctttcaacaactttctttgcgggatggagatc

SEQ ID NO: 78604 - DNA, 149 bp, Zea mays
  Clone ID: LIB3088-026-Q1-K1-G10
gcactccttatggatacacccaagctttccctttccttaattatctaggcgccaaatcgggcttttataacgaccgacggggcttaaactcccgaaccgttgctggatgcggcccttgaggcacctaaacacaccctgatgactcctgt

SEQ ID NO: 78605 - DNA, 228 bp, Zea mays
  Clone ID: LIB3088-026-Q1-K1-C1
aataacttagtgggagaatccttctttcctagggaaagggtcaaaggtttaaaggctgaaaaattctccttccaatatggtttttataaaaaacaactatgccagaactcacatgaaaaaacatgtgttggaggcacacattatgggaaaaacggtaaaaaaataggagtacagaggtggaacacatgaaaatacaaggtggaaggcatgtgttatgtggaaataagt

SEQ ID NO: 78606 - DNA, 343 bp, Zea mays
  Clone ID: LIB3088-026-Q1-K1-C10
cccacgcgtccggaggcattgtcagtagtgagcaaggccagcagcacagcagagcatcgactcaccagggagcagcacggcgactgcgcggcgtggctgaacctgacgctgggcgcgagcgaatcgccgtcgccgtctccgtccccggacgccgcgagctgctccgcggactccgagtccgggtccgggtccgggcccgggcccgccgtcaagccgaccccgcacaaggtgttcttctgcaacttctgcctgcgcaagttcttcagctcgcatgcgctgggcgggcaccagaacgcgcacaagagggagcgcattgccgtcaagcgatcctcgttccacgcgc

SEQ ID NO: 78607 - DNA, 90 bp, Zea mays
  Clone ID: LIB3088-026-Q1-K1-C11
cccacgcgtccgcccacgctttcgcggacgcgtgggggttaaagcgatgggaaggttggatcaatgtcgcagagattaatgcatctttcc

SEQ ID NO: 78608 - DNA, 436 bp, Zea mays
  Clone ID: LIB3088-026-Q1-K1-C2
cggacgcgtgggcacatctttcagcaactttctttgcgggatggagatcttgagagcggggctcgcacagctcctgctatgctacaccaggctctccgagtgtgtcaagagaatcaacggcggctctgctctcaacaaggaccttgtctccatatcctccatcctgttcgaaatcaagaagtattctaggacgttttagttgtttcacccccttccatgtacactaggacggctagctgaggggtagctgtgtatccttactttgtaactggtatgtgcgactgcaggggaaacaagggcattttgtcgtggtttgtatcttcgtctgtgttacccgacttgacccctgcccctttccagcacagaactatgatctctaagctgtctccacagttatcctattctatcttctgtcctatcatctattttaaacttc

SEQ ID NO: 78609 - DNA, 439 bp, Zea mays
  Clone ID: LIB3088-026-Q1-K1-C9
cccacgcgtccgcccacgcgtccggttatatacattgcacccgatcagaagggatgctgtataatgcagcctgggtgtgatctccgtacatcgtgctccagccgcactcagatctagccttggccgggagacaccgcgacagaggctggacgtgctcttcccgtcctcatgcccccacgccactgcgcgctcttcccttcacctctcactacacgacggttgcggggcaggggtgaaagaggcgaggcttctccagcttctcgaggccggagaccgtttgctcaagggtgtcgttcttgacggccttcttcgacagcgtggacgcgtggttctcagcctatattattattgtattacattggacacattaggaaaggaaaaaattccgtgaattgtagggtgtgatctgtctgcctatacttgtggtggcattcatttg

SEQ ID NO: 78610 - DNA, 132 bp, Zea mays
  Clone ID: LIB3088-026-Q1-K1-D9
tccactcgtccggaaaaagtgactcgtttctagtctcccaactccttcttcagggattttgagtgccatggttggttcatcggaaccactgttttcagccactcctatactgttgttgtgtgccctgtcttt

SEQ ID NO: 78611 - DNA, 354 bp, Zea mays
  Clone ID: LIB3088-026-Q1-K1-E10
attcctcccatctcccaagacctcctcagacccgagaagcgcagctgcgggcatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaagtcctggagctcgccggcaacgctgccaaggacaacaagaagacgcgcatcgtcccgcgccacgtgctgctggcgat

SEQ ID NO: 78612 - DNA, 435 bp, Zea mays
  Clone ID: LIB3088-026-Q1-K1-E11
cccacgcgtccgctctctgccttccctacctcagatcctccctcagattgccatggcggaccagctcaccgacgaccagatcgccgagttcaaggaagcattcagcctcttcgacaaggacggcgacggctgcatcaccaccaaggaacttggaactgtgatgcgctcgttggggcagaaccctactgaggctgagcttcaggacatgatcaacgaggttgatgctgatggcaatggaaccatcgacttccctgagtttctcaacctgatggcacgcaagatgaaggacaccgactctgaggaggagctcaaggaggccttccgcgtgttcgacaaggaccagaacggcttcatctctgctgctgagcttcgacatgtcatgaccaacctaggtgagaagctgacggacgaggaggtggatgagatgattcgtga

SEQ ID NO: 78613 - DNA, 119 bp, Zea mays
  Clone ID: LIB3088-026-Q1-K1-E12
taaaaaaaaaaaaaaaaaaaataaaaagtttaaaaaaaaaaaaaaaaaaaaaaaaaaaaaggaaaaattataaaggaaaaaagggaactaaagtccttcctttttaaagcttccatcct

SEQ ID NO: 78614 - DNA, 436 bp, Zea mays
  Clone ID: LIB3088-026-Q1-K1-E9
catccaggagatgttccggcgcgtgagcgagcagttcaccgccatgttccgcaagaaggccttcttgcactggtacacgggggagggcatggacgagatggagttcaccgaggccgagagcaacatgaacgacctcgtgtccgagtaccagcagtaccaggacgccaccgccgacgaggagggcgagtacgaggacgaggaggagggagatctccaggactagaataggctgcttcacattcagtcaccgtcagtcatgaaaaactaatcatttgctgcttttcgtcgtcgtagtagtagtaggtcggtaatcatctgtcgtgggtttgtttcgtttctatcattaatcagcattagtagtagcagctgctgctgcgggggcacaacacaagggggggataggaactgcaataccctgttgcgctttgggtgtttc

SEQ ID NO: 78615 - DNA, 433 bp, Zea mays
  Clone ID: LIB3088-026-Q1-K1-F1
gttcgtggcaacccgggagtgagggtaaacatgtgtagggagggcagctggtgtgcttgagaacgatgaggaggggagacgttactgcatgcatggcctaagaagctgtgtgcacgacaagactcctgagatcatgcctgcagttaacaagttcttcactgaccctaagtgaagcatgttgattggcatactactactactacttgctactggggattttacactttgctggcaactcaatatgttggggacatccatgacctctaaaagtactttgagcgcttggtgatgacttggtatatgtatgatggtggatgagtttgatcgtccatgcttgatgttcatattcatctgtcatctggatttgccgcacttcagtgataaaattgtcatttggatactggtaatggtaccgtcttgtgaagttcgctcc

SEQ ID NO: 78616 - DNA, 448 bp, Zea mays
  Clone ID: LIB3088-026-Q1-K1-F10
cggacgcgtggggcgtttcagtggctctgttaagttgccccatatccctcgtcccaagagtgaaggtgtgcatgcttggtgatgcccagcatgttgaggaggccgagaagatgggacttgactacatggatgttgaggctctcaagaaaatgaacaagaacaagaagcttgttaagaggcttgccaagaagtaccatgctttcttggcatcagaggccatcatcaagcagattccccgtctccttggtcctggtctcaacaaggcaggcaagttcccgaccctggttactcaccaggaatccctcgaatccaaggtgaacgagactaaggcaaccgtcaagttccagctcaagaaagtcctttgcatgggcgtcgccgtcggcaacttggcgatggatgagaagcagatccagcaagacatccagatgagcgtggaactttcttgttt

SEQ ID NO: 78617 - DNA, 382 bp, Zea mays
  Clone ID: LIB3088-026-Q1-K1-F11
gtaccggtttcgattcccggtcgcgcacgcgtccgcgcgccagcccgacccacccgccgtacgccgagatggtctcggaggcgatcacgtcgcggaaggataggacggggtccagcagctacgcgattgccaagttcgtggaggacaagcacaaggccaagctcccgcccaacttccgcaagcttctgaacgttcagctcaagaagctcgtcgccggcggcaagctgaccaaggtgaagaactcgtacaagctgtcgtccgccaccaagccgaatcccaagcccaaggccgccccgaagaagcccaagaccggcgctaagaagcccaaggccgttgccaagcccaaagcttagacccccgccaaggcgaagcccgccacaaa

SEQ ID NO: 78618 - DNA, 466 bp, Zea mays
  Clone ID: LIB3088-026-Q1-K1-F2
tcgccccactcgtccggcaagatccgtgaggccaggggtgaatgtgacttggggtttccctgtgcctgctagcagccggtaccttgtgcgtatgcgcttctgtgacattgctagcaaggctctgtatgagctctacttcaatatctacgtcaatggtgatcttgcagtcaaggatttcgatctctccagtgcaactggattcttggcctatccttattacattgactttatcgtcgatgtgaaggatgaggggatactgaaattggcgattggtggcttaaagaagagtcgatctgatgaagtaagtggtatccttaatgcactggagataatgaggatgaacaagaccagtggaggtatggatggagacttcccaattgatctacacatggaatatgtggtgagtaaggggattggagaaatttgccgcttccttgctctgtggtttcatcttttgtgggttgtt

SEQ ID NO: 78619 - DNA, 358 bp, Zea mays
  Clone ID: LIB3088-026-Q1-K1-F9
cggacgcgtgggctggaatgctgccacatgggctggggaacctccgtcatggtcggcggcgccgtctctggcggggagagcgccacacgaccattccagctcgtgactgggcgtgtctggaagggaaccgctttcggtggcttcaagagccggacccaggtcccatggcttgttgacaagtacatgaaaaaggaaattaaggtggacgagtacattacgcacaacatgaacctggctgacattaacgactccttccatcttgctgcacgaatgttgctgtctgcgtttgtgtgcttgcattgcagaattgaaattctcttaactaagcagtttttgttttggaactagaacttttttt

SEQ ID NO: 78620 - DNA, 465 bp, Zea mays
  Clone ID: LIB3088-026-Q1-K1-G1
atcgcccacgcgttcgtagagatgcaagagccggtttccctgacctttgccctaaggtacatgaactcgttcacgagaggcgtcttcactgtccgagcaagtcacgatcagcctgtcgtccgagctaccagtggtggtcgagtacaagatcgctgagatgggttacattagattttacctggcgccaaagatcgaggacgatgaggagatgaagccatgattgccatcagtgctcgtgctgccgactttttctcgtcttccatccatggtttgcttattagctattatttgcacgcaaaggaaaaaaaagatgttatgttttatatcttaggccagactgctttagctacttatttgtgactgctgtgtgtccatggatttatagtgaatctagattagtgggcttgtgctttgtgcatgccgctgctgtctgcccattttctattcagacatgaaattctttgt

SEQ ID NO: 78621 - DNA, 419 bp, Zea mays
  Clone ID: LIB3088-026-Q1-K1-B9
cggccgccctttttttttttttttatcaataattcaatccggacggacgagcgactgtgccgattcacctcattttaccagtccatgaatcaaaacaacagaatcatcacctacaccgaaatacttatgcccgatccaatcgcagcacgaatgaatgcgtcgacaatttctcatgcgaccacgaaggcacgaactacacacttttttttgttgccggtctcacagcaatcgtctcctactcccggcattgctgtaggggagctcaaagatcccgagcttgctgtgagcgcgacgacggccgtggccgcttcactcacttggcgccgacgccgagcgtgagctcgagctcctcggcggcgacctcgtggatgcgctcgccttcccacggcgtgacgcggcccttgtcgaactcgaacttc

SEQ ID NO: 78622 - DNA, 401 bp, Zea mays
  Clone ID: LIB3088-023-Q1-K1-A2
gccgataacttgcccgaggagctgtcagaaatcctaacatcctgctggaaggaagacccaagggacagaccaaacttgacacagataatacagatgctcctacactacctatccaccctttcgccacaagagaccttggcgggcccccgccgcacgttcagctcggagaacacaatcctgcccccagagtctcccgggacaagctcgctgatggcttcgcggggcgacctcggcgacacgcccaagggcaagaaggaagacaagccgaggggcttcttcttctgtttcagcgagtgctattagcacgagcccccccaaagggggaacactccgagaagcttgcaaatactgaacgaacaccgtctcccccccagccccgatgccctgcgactcaagccatg

SEQ ID NO: 78623 - DNA, 379 bp, Zea mays
  unsure at all n locations
  Clone ID: LIB3088-023-Q1-K1-A4
gcgcggacgcgtggggagaaaatgggaatgcatgagatgagggttctggttgctgaaaggtcgaggatgagcatatacatcaagggagaagacttggaagtggagcanaattgcattggcattttgctggaagggttcttgaagatcgagaacctgactctcatcacgcccccagcgttgcttctgccatggaatgctgacttgagcttattcggtctcgagtcctcagactactgccatactgcacgcaggtatcaggtggaagccagagcgcggatcatcttcttcgacgaggcagaggccgcccatcttcatgttcagacaagtgcgtcgctgccccaaggtgagccagcacggagcatgagcaaggagcacagcg

SEQ ID NO: 78624 - DNA, 490 bp, Zea mays
  Clone ID: LIB3088-023-Q1-K1-B1
gggcggccgacgcgtacaaccggcacgatccccgacaaggagatcctcattatcgtgaaggagaacttcgactgcgggcgcgggattatcagcatgaacctggacctgaaaaagggcggcaacaggttcatcaagaccgccgcctacggccacttcggccgtgacgacgccgacttcacctgggaggttgtgaagcccctcaagttcgacaaggcatcggcttaaggttgggagtgttcactgtggacatgaggactaccttcctctggctctgctgttacctgcaagcattgctgctgctggatgtgtgtgtttgatcagtgactggctgctgctccataaaagatgaacggagagaaggatgattaagaagggctttggcaatcgccgctgcaactgcaacccatgccatgccggcttagtgattgggtataattttgctttgcaagcaccagcattattatgtgctgatcttttatctttactagtt

SEQ ID NO: 78625 - DNA, 464 bp, Zea mays
  unsure at all n locations
  Clone ID: LIB3088-023-Q1-K1-B2
ggtacgtactantactacgtatacgtacaagaatggagcatgcaatgtgcatgcacactgcgtacatttagtatgtgcttgtgtcaaatgtatcgtcagtatcatactgatctcctggcatagtctggcactaaccataggctctccttttcttttgtgttggacaggtggtctggatcaatggaagggttgtgtcctagccagccggcaaagatgagctgctgatggtaatgatgatgataagaggccactgctaccctactacgtaccctcctctttgtgtgctgccatccgtccccgttagacgatcgaggagagaataacgcagagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccat

SEQ ID NO: 78626 - DNA, 264 bp, Zea mays
  Clone ID: LIB3088-023-Q1-K1-B3
ctcgcatctacctctagcacattgtacgagggaaaggttcagaggtagtacaatgggtatgtgccactcatcaaagaagtcggcggttaaacctctttttcttttgggggttgggggaagattcattttgagatgaaaataattcctttgcagaagatacatacaaatttggactgggaattttagcagtctaaccagatacatctggatagatattgtaaaagagatacagctggatcaatgagcattctttctttcacattt

SEQ ID NO: 78627 - DNA, 313 bp, Zea mays
  Clone ID: LIB3088-023-Q1-K1-B5
taaacgtgttaaaaatagcccttacagagatttattggatgtctctcaacattcgaagactgtacattaagtaaatgcgtgctattctatcaatccaaagtcatataatagattccaagcttacaatcttgctaaacatattctattctacacaaaatcatctgaacgaaagggcggcatattctacaatcaatgactctaccactgctgtaaagataaactcatcaatataaatatgatgataaaaggtcaatgataacttactacatacactaatctttccttgctgctatacgtgccttttccacgatct

SEQ ID NO: 78628 - DNA, 331 bp, Zea mays
  Clone ID: LIB3088-023-Q1-K1-B6
gcaagcaacagatacacaagctgcttcagttcaatcaagaacaacaacccctgcacgaggagaggataggaggctcaccggtcgcgaccaaattctcccagagacggtcggaaatgaggagccaagcgctgctcttcctcacgatcgcccttctcaccgtgctcgcgcgatccatcaacaggcaccaccaccaccaccactcccacgttcaaagcatagggcagtgagcatcatcatgatgaggaggaggaggaggtgagctggcgagccgggcgccggcgccggcgcgcgcttggccgtgctgcgacagctgcggcggctgcaccaggtc

SEQ ID NO: 78629 - DNA, 269 bp, Zea mays
  unsure at all n locations
  Clone ID: LIB3088-023-Q1-K1-B9
aaacctgtgaatatgtttccaaatcgttctgtttaatctgcctgtcaagtgctantagtgtgcgtgttattaccagtgcggagggcggcgttaaatttgcgttttgctacctcttctcgagaataaacatagttgacattactcggctcaaaaagttcagatcgactcaattgttgttgcttttttttttttgccttgatttttcatctcgctcagctcgagtgagcacgttctattgttaggttgcctcatcttggttatcaccggac

SEQ ID NO: 78630 - DNA, 458 bp, Zea mays
  Clone ID: LIB3088-023-Q1-K1-C1
gtggtcacacttgcttcaaagggatgcatggcaaagcatggcaaacaggtcgttcgagtgcgggccatcggggagagcgacgcggtggacacaactggagcgggcgacctgttcgcgagcgggttcctgtacaggctggtgaaggggttgccgatggaggagtgctgcatggttggggcgtgcagcggcgggtcggtgacgcgggcgctcggctgagaggtgcggccggagaactggcagtggatgtacaagcagatgcacgccaggggcatgctgctccctgagctcaagaactgaactaatcatgctgcagctggtgttagctgcatgctgcaccagctgttgtatctctcagcactcctacctttcccctgctagaatattgaaccactcctgagattgaaccaatcagatggagtgtattgataattgcacttcatatgtgtgctagtgtacta

SEQ ID NO: 78631 - DNA, 267 bp, Zea mays
  unsure at all n locations
  Clone ID: LIB3088-023-Q1-K1-C11
gcgcccacgcgtncgtcgagcacattgtacgagggaaaggttcagaggtagtagaatatatatatgaccggcctcaaaaaaagtaacttgttagtttctttttcttttgggggttgggggaagattcattttgagatgaaaataatttctttgcagaagttacataccaaatttgactgggaattttagcagtctaaccagatacatttggatagatattgtaaaaaaaatacaattggatcaattaacattttttcttttagattt

SEQ ID NO: 78632 - DNA, 316 bp, Zea mays
  unsure at all n locations
  Clone ID: LIB3088-023-Q1-K1-C3
catatanntttaacnntttgacnnaaggatgtnntatgagcntnntggatgnnnaaatgaaaggganntaatttcttagagngnntccacccanacaaattcttcactttgtgatgaacacannagcatggtcatttatctttcacnaagaagggcnnctttatttttcattatttannatttcaatcctcaagtcttcccattccgtcgtatttcgtgttggtgtggatgaaagctggggaataaccaactcatcttcaacacagatgaaactaaatatggtggatgtgaaaccctcaagagtagtcagtatatg

SEQ ID NO: 78633 - DNA, 388 bp, Zea mays
  unsure at all n locations
  Clone ID: LIB3088-023-Q1-K1-C4
cccacgcgtccgcatcgtgaaatagctaagaaaccaaaggtccagtcaccancagaggaaatgttctgcagcgagaacaagtctccagcaaagcaagtgtttggggatcagaacaaatcgtcatcaaaccaaatttttggagatgaaaacaaggagccgtcggcatggggtgctatagagactcccatgtgcgatgttagagtgactgacagcccactgtcttctcagctttctccaatcgtatgccaagttgtggctgcaccattatcagaggaactgaatacatgcagtgcagtggaaggaagtgatcctagcaaggagaagaacagtcttgctggacagaaagatggcggccgcctcttggagtttacataaaatgggagtctgc

SEQ ID NO: 78634 - DNA, 289 bp, Zea mays
  Clone ID: LIB3088-023-Q1-K1-C5
aaaaaaaatacaaataataaaattatttaaaaaaaaaaataaaaaataaaaaaaaagggagaggttatttaaaaagagcgggtatgcaaaaaaaaaatatatttaaaaataataaaaaaaaaaaaggggcgcccgttttatagatttcaagtttacgaacccgtccattcaatttaatatcttttttttgatgtcccataatttaatttctgtgcccctattttaaaaacatcttaattgaaaaaactttgaagttaccaatttaattttcttagaagaacttcctttt

SEQ ID NO: 78635 - DNA, 288 bp, Zea mays
  Clone ID: LIB3088-023-Q1-K1-C6
acgcccaaatctactcattgtatatactttctattactgatcgtccagcattaaaattgaggactgttaatctagaagcagcgtctggctacaaaaaacatttttctttgatcattacaaaaacatatctatccaaatttttatatattaatttaccgagccaccatcatttttgctctagacactctaatatgctatcttgaaacgtctgtctccctattgtcttatcaattcaatccaatcaaataccattttttcttttcaattttatcacatgaacttactaca

SEQ ID NO: 78636 - DNA, 323 bp, Zea mays
  Clone ID: LIB3088-023-Q1-K1-C7
attcactgtgagactgatgagacattaaactgctgtttcctcaactctacacttctgaagagaactatcgggtgcatcgccttcgatcgctaccattgtgttttatgggtcaacaagatgtgatgcccacaagcttttccttggacaatgctgcagcctgcagcttctaacctgtagaaccaacatagtcaggtttcaccgaacctactcactcttgtttccaccaggccaactcaactctgaatgaccgcttgaagagtccaagtcttacttcagcttaagaatctaaaactcgtttagtctctcggcctttttcgtattat

SEQ ID NO: 78637 - DNA, 327 bp, Zea mays
  Clone ID: LIB3088-023-Q1-K1-C8
cccgcacctcctgctagcacagggtgcaagggaaaggatgacagacaggacaatcgagagcggcccatcatgaagggcggcggggggtacacaactgtatctgtcgaccgtgtgcggaacaggttattctgacatgactataaaagcgttgccgagggacgaacctacatggactgggcatgcaagcactgtaaccagacacattcgcatagatgataggaacgagctcagaactggtcaatgaggatcaagcctatgcaatccaggggcatgctgctccctagggcgaacaacctaactaatcctactttacctactgttacctgc

SEQ ID NO: 78638 - DNA, 357 bp, Zea mays
  unsure at all n locations
  Clone ID: LIB3088-023-Q1-K1-D1
aaaacttcaatttcctatttcaagttatgactattccttccaattanctgatcgggtttaaatactgttgggcaaagtttttcataaacatatatttaactttnacaaggatgttatgagcttggatgaaaatgaaaggataatttctagaggtccacccaacattcttcactgtgatgacacaagcatggtcatatctttcacaagagggcctttatttttcatatttaatttcaatcctcaaatctcccatccgtcgtatcgtgttggtgttgatgaagctggggaataccaactcatcttcaacacagattaaactaaatatggttgatgtgaaacccttaaaaataatcaata

SEQ ID NO: 78639 - DNA, 425 bp, Zea mays
  unsure at all n locations
  Clone ID: LIB3088-023-Q1-K1-A10
gcactcaattccatgacagaccgtcagaccctgaagctccagaggagaaagaggaggacatggacaagaggccacctcagcgcagcagattatggagcggaggagcttacgactctgatacagaggatcctgacagcctgaaaagcgagggtaaagacgtaactgctaacttccagatgaaggatgaaccaaaagatgatctgtagaagtttcagaagtgcccccaaagttactgagttgtcaatgggatcgtcgacatgcatgttgaagagtggggacgcatctgaacctgtccgtgctgatatctgccgctgtgcatctgtaacagactgaacgttntgctggttccagctttcctgcgtgttggtaactagactagatatatggccctttggtgggtcccaaacttgtgagcttggagaatg

SEQ ID NO: 78640 - DNA, 443 bp, Zea mays
  unsure at all n locations
  Clone ID: LIB3088-022-Q1-K1-G2
cggttcgaattcgaggcagcggccgctgagctacaatatttgtactaccatgctgtagctgttgcaagcgtcgacctaaatgcgcaccgtggtcttaaccttgctggtcaatgccgaactcaagctctagctgatggcgctgatcctcaacatgcatactatactgaagacttaaccacatacactgctagaatgagctacacgacgcccaactctggtgttatatacactgtgaccaacagagtactcaacatcttcctctacatactacaacctcgacgagtgcaacctacacncgtcacacgagaactgagacacagattgtcatccaactggaacaccatctcattcgcgacgcaccatgcctttaacgctttgaccactatgaaggctcgctttatcgaccactgattggacagtgcactgatccaacacgagtagat

SEQ ID NO: 78641 - DNA, 431 bp, Zea mays
  unsure at all n locations
  Clone ID: LIB3088-022-Q1-K1-G4
cccacgcgtccgagcggatcgagatggcggcgtcggatgttgagtaccgctgcttcgtcggcgggctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaagctgcggctacggcggtggcgggcgccgtgatggcggcggcggctacggcggtggcggcggctacggtggtggcggcngcggctacggtggtggtggc

SEQ ID NO: 78642 - DNA, 288 bp, Zea mays
  Clone ID: LIB3088-022-Q1-K1-G5
cggacgcgtgggaaaaaaaaaaaataaaattaaaaaaaaaaaaaaaaaaaaaaatggaaagagtaaaaaaagaaaaaaaagaaaaaaaaaaaaaaaaataaatatattatattaaaatataaataaaattaagtttgttcattttacaatgatcaatctttacactcccatgtttccaaaactaaagctttcttaaaatgtcaccaaaataaaatacactgaactccatttaaaaaattatctattggaaaaacctcagatttaccaatattaataactttgaataat

SEQ ID NO: 78643 - DNA, 430 bp, Zea mays
  Clone ID: LIB3088-022-Q1-K1-G7
aacgatcctccgttcccatcttccttatccagatggcggcgccggccaactccgccaccgtctccggcgacgtgtgggcggagctccgcctggccgacgcccgcgacgtgccgcacatccaccgcctgatacaccatatggccgagttcgagctgctcaccgacctcttcgccgtcaccgaagagctactcacgtccacgctcttcccatcgccgacgccgactgccttcacctccttcacagccctcgtccttgacctatcccccacccccatactcccggactcctctatcaccatcgcctaccgtcggctcgacctctccgcgtccccgctcgcagacccggaggccgccacctgcgccttcccgagcggcggctggcgcgtcacggccgggttcgtgatctgcttccccaactactccaccttgct

SEQ ID NO: 78644 - DNA, 442 bp, Zea mays
  Clone ID: LIB3088-022-Q1-K1-G8
gatagcttacctcccatcgacggtcggtgagccgttcgtgagtggcgaggcagtgcgtgcgctgcagcctgcagggcaagaacaggcgacgaagaagatgagcacgctggacacgcggacgctcaaggacgagctgacgagcatggacaggaagtgcctcgtggacctcggccacccgctcctgaaccgcgtcgccgacagcttcatccgcgccgccggggtcggggcggccagggccgtctccagggaggcctacgtcgtcaccgtcgaagggctttcaggagactcgtccgggctggacgccgacggcggcaagcggagccatttctccagcatcagaggcgacgacggccagaggtcgctcgacgcagtggtaaaaacggccggcaaggaggccttccagtgggggttggcagccggagtctactctgggctcacgtac

SEQ ID NO: 78645 - DNA, 385 bp, Zea mays
  Clone ID: LIB3088-022-Q1-K1-G9
cccacgcgtccgatccatggagctcgacgccgacaacctgagcgccaccgagctccgcgtcggcctgcctgggaccagcagcagcagcagcgacgactggcagaagaagccgtcgccctccgtcggggccaagcgcgctctggacgacggcaccaagagcgaggcctcggggaccagcccggccgccagagacctcgacttcgaccacgaccacgacaccgtcgcgcctcccaaggcgcaagtggtcgggtggccgccggtgagggcgtacaggaagaacaccttccaggcggcggcggcggccaagaaggtcgagcagaatcagaagcagcagcagcagggaggcctgtacgtgaaggtgagcatggacggcgcaccgtacctc

SEQ ID NO: 78646 - DNA, 386 bp, Zea mays
  unsure at all n locations
  Clone ID: LIB3088-022-Q1-K1-H10
gnggaggggaggatcgcaaaactagctgcagactttttggtttctccttgactgaagagatcttgccagcagatgatgatgacgtcaaggaagtgagctatgagactgagtgccagaacccacggatgctggacctgttcgggtacaactgctcaacaccgagtgccgctcttccagctctgtgtgctgccgccccctttggaatgtgatgctgcttcgaatctttcgataactttgctccatgtactcttagaagttttactttcccagtaccccagtgtagtcataagctgcttttgacatcattccctttggtctgcctcaagttaagcaggcatttgcacaagtaaacgaaggttcgttggtgaaccactcctcgacatgcc

SEQ ID NO: 78647 - DNA, 267 bp, Zea mays
  unsure at all n locations
  Clone ID: LIB3088-022-Q1-K1-H11
aaaaaaaaaaaaaaaagaaaacaaaaggaaaaaaaaaaagaaaaagaaaaggaaaacagggagaaagaaaaacagagaacagggccgaagaaaacaaaaacaaaaaaaaaaggaaaaagaaaaaaaaaaaaaggggcgcccccccaaacgaacccaggccagcgcccccggcccgccaagcaaaacgagcgggaaagggaaccccaaacacaaaccacgggcccggcggnaaacaaacagccaccgggaaaaccccggccgaaccca

SEQ ID NO: 78648 - DNA, 142 bp, Zea mays
  Clone ID: LIB3088-022-Q1-K1-H12
aaaaaaaaaaaaaaaaaaagaaaaaaaaaaaaaaaaaaaaaaaaaaaaaaaaaaaaaaggaaaaaaaaaaaaaaaaaaaaagaaaaaagaaaaaaaaaaaaaaaaaaaagggggggaacaaaaaaagggaaaaagagaaaag

SEQ ID NO: 78649 - DNA, 357 bp, Zea mays
  Clone ID: LIB3088-022-Q1-K1-H3
cccacgcgtccgcccacgcgtccgcggactcgtgggttgccattgattaacggggttgagctttgtagtaacatctgaagagttgagagtttccttggatggttgaaccaccagaatacatacaagtttgagtagacaatgcttctatccttgtaccctcgtggagtctttgtgaattgcctcgtaggaattttggtttttacatgatcttgaggcataaggttgtaaaattagtcgaaaatctgtatctgttgtaaagggcatggactttggaccactgaaatggctgtcaagctttcgtatactgcaatgtatgctgttcaaaagtcaactattcaaatattcgattattccttg

SEQ ID NO: 78650 - DNA, 436 bp, Zea mays
  Clone ID: LIB3088-022-Q1-K1-H4
cccacgcgtccggagcacctctccttgcttcactttctgcccaactccggtgagcgagagtgtggtgacgacagaatcatggcgctgcccgtggggccaatcgtcggtgcgcgagctccccttcggggtgagcatgtcaccgtcgagcgacctcttggcggtgccctagtgtcctgtgcgtggcgttatgtaccggtggctgcgttgtttctacccagtcgtctgcaaacaagattagcaagaatggacgaaatggtttgagttggttctctgagcaggttgacaagtgaggacctctatgaagctgatgctaacatttacagagcaaaaggatctatattagagcagtataaatggtggatgtgaggcttacattggttgtgagcttgaaagggaattttgttgttggctggtgaggttcttttgactcctgatg

SEQ ID NO: 78651 - DNA, 437 bp, Zea mays
  Clone ID: LIB3088-022-Q1-K1-H5
cccacgcgtccgcccacgcgtccgcccactcgtccgcccacgcgtccggttcctctgaagattctttccattgaggatggtacagtcttgaagtccttcagccaccttctccatcgtaacaagaaggtagatttcattgaacagttcaatgaaaagcttctggtcaagcaggaaggggagaatcttcaaattcttgatgtaaggaacttccaattgacagaagtgagcagaactgagtttatgactccatctgcctttatttttctgtatgagctgcaactgttcctgacgttccggaatcgatcagtagcagtttggaactttcgaggtgaactggtcacatcatttgaagatcacctgttgtggcaccctgactgcaacacatacaacatatacattacaagtgatcaagatcttattatttcatactgcaaggc

SEQ ID NO: 78652 - DNA, 236 bp, Zea mays
  Clone ID: LIB3088-022-Q1-K1-H6
cccacgcgtccgcccacgcgtcctcccactcgtccgcccacgcgtccgcttaggcttaggattatgcgaattcaggatcggacagattagtaatcattcagccaacttaatcatcttaacaataaacttgaattcatcaaacaactcaatgaaaagctcctactcaaacgatcatgtgataatctcctaatacttgaagtatgtaacttacacttgacagaaatgtgatcatctga

SEQ ID NO: 78653 - DNA, 413 bp, Zea mays
  Clone ID: LIB3088-022-Q1-K1-H7
cccacgcgtccgcccacgcgtccgtcaagatcgaaatctgctaatgtttctccagcaaagtgtgaatcagcaggcgccaagaagcagagcccaaacaggagcccatctggctcacgctctcctgatgcgaagcctgaataaaattgctatgctgttaaaggattgcagatggagtcaggagctcttcttttcttaacatttgtcctctgttctagtaccatcagtgtcttattgcagtacgagattggatgatattaactatctgtatcagctcgtatcgatggactccaagtgttgtcactcttgttgtctagtgtgctgaaggacccatttactttaaaataataaaaagatcacctgttgtgacaccactaactgcaataaaaaacaacatatacattacaagtgatcaa

SEQ ID NO: 78654 - DNA, 295 bp, Zea mays
  Clone ID: LIB3088-022-Q1-K1-H8
tcatcctaccactcgtacgaccactctttctacgatttctacatctactaatacctatacgtcaaatgtatattcaacaatgggccatgaccctcatcccaatcatcatcccacctgcttcactctctactaatcctaataccatataaacaacctattctcataacccatttcacacttactcatcatctcttctcatcttatcatttatcctctcccatactaccataaacatcattatccagtatgacattacatgatattaactatctgtataacattttatccatttact

SEQ ID NO: 78655 - DNA, 206 bp, Zea mays
  Clone ID: LIB3088-023-Q1-K1-A1
acgcccactcatccacccacattgaacatgagataatactatctctccatatactgggtaggggtaaacttaaaagggcggtggtaaatataactatttaacgatattaccatctattattacgataaatactattgaaccaactgctgttgtgacctatgagatgtccatttaatcctataatgcaactgtcaacatgatgttta

SEQ ID NO: 78656 - DNA, 342 bp, Zea mays
  unsure at all n locations
  Clone ID: LIB3088-022-Q1-K1-G12
cggacgcgagggcggacgcgngggaggcgccgacgcagccgaagacgggccgcagcgggggcatcaacaagggccanggcgacaccaagcgcgagctgccacngcgcccggcccaccgcaaggggaaagcaacgaagagggngaccaaggncaggggcccaaacagagagggngccggctgggcaccgaaagagaagcggancaccgagcnncagaaggnnggcaaggacaagcgcgcncngaagcnngccaagagaaagcnnggaacccacaagagggcaaagaagaagagagaggagaagaagggcgagcacaggaagaggagaacggccgagacgcaca

SEQ ID NO: 78657 - DNA, 436 bp, Zea mays
  unsure at all n locations
  Clone ID: LIB3088-022-Q1-K1-D7
cggacgcgtggggtgggagcacctcagcaatcaagaagccgttgagattgttcacagcggtcaacgtgctggaagcgcaagaagactcattaaagccgctctacaagaagcagcgcggaagcgtgagatgcgttactcggatcttacaaagatcgataagaaagttcgcaggcatttccatgatgacattactgtcatcgtcttatttataaactatgacctattattgaaaggtgctccgcagggacaacccctctccatcagatgtgccctagattattgacagtgagctagttcacccactggtattcaagctcctgcgggcagccatatccagagtcagctgacatggtcaaccggttgtgaaaagcgcacaacctncggcaccagtttccttttcgtttccccttttttgcacataaaattgacaagtcgc

SEQ ID NO: 78658 - DNA, 369 bp, Zea mays
  Clone ID: LIB3088-022-Q1-K1-D8
gaagaacgcgccaaattatgcacataaatttaagctacaccgaaggcaaaaaaaacaacgggcaacttattatgcgcacgcgaatactcagtaactctcgtctccatgactaccttctaggccataataatcattagttggatctgactcaaatcctgctgaaagttcatctgcatagtcaatatcacattaatgccttaaacttataaataaactatgacctattattgaaaggtgctacacatttacaacaccctctgcatcacattttacataaaccattgtcagttacccatactctcccactgatattcaatgctatagcgtgacctcatttccatagacagatcacatgtttacaacgttgtg

SEQ ID NO: 78659 - DNA, 304 bp, Zea mays
  unsure at all n locations
  Clone ID: LIB3088-022-Q1-K1-E10
gccaattatagccgantacctggaatcttcgacagtgagattgacgaggatatccctaggctgaagagagttgcggcttcagtgctaagcgagatgggtttgaacggagcatccttatcccaagacctggtaaccgagatgtgccggttcgggggtgcggagattcatccagtggctgctttcatcggtggagtcgcttcacaagaagtgattaagctggtcaccaagcagtttgggcctttggggggaacattcatttttaatggaatcgatctcaaatctcaagttttggtgctataacatg

SEQ ID NO: 78660 - DNA, 273 bp, Zea mays
  unsure at all n locations
  Clone ID: LIB3088-022-Q1-K1-E11
ccggcttggcatgaagggtgcaggcctcgnnaaaaagctagagacgngngggangngggggganagnagcagggggnnatatatattcagttgtgtgtttactatttaatgcgaggagtgaaaataatagtacctgtaccagtctgtgtatggttattacttccaaaaaaaaaaaaaaatttataaatttataaaaataaaaaaaaaaaaaataaaatataaaaataaatataaaagaaaaattaaaaaaaaaattaaattaaataataaatt

SEQ ID NO: 78661 - DNA, 68 bp, Zea mays
  Clone ID: LIB3088-022-Q1-K1-E2
aaattgtcacaagctgacttcatggcgttaaaattaatcacagaaacaggataatcaagaactagatc

SEQ ID NO: 78662 - DNA, 424 bp, Zea mays
  Clone ID: LIB3088-022-Q1-K1-E4
gagagatccggagcagccgcagtcccacttatccttccgccggtcgccctccatctccgggccggtgcctctcgtttgtggtttcaataatcaagatgagccgtggtggtagtgccggtggtggtcaaagttctctgggttatctctttggaagcggtgagccctccaaaccagcagtggcaccagctgcaagtgctccacctgttgagaaaccatctgctgcaaagactgatgcggccaagcatgttgctgctggggttaccagccaaaccaataactaccacagggctgatggtcagaacactggcaacttccttactgaccgtccttcaaccaaggtccacgctgctcctggcggtggctcttccctgggctacctgttcggtggcaactgatgcccgtgctggtgcgctcaccaaagtta

SEQ ID NO: 78663 - DNA, 237 bp, Zea mays
  Clone ID: LIB3088-022-Q1-K1-E5
ctcacgcgatcagatacacgatttttcgtttaacgcaaccggtgtaacactatggctgcggactattagctgggagagggggatactgagtgttagcaaaaagtgtgtattgccttcaacgtatgttgacgcacttcatgctgaaaactaataacaaaataatgctagaaatacaaattaataaaataattcttttaaatactctacacactaccgtacgtatgcaattacttgcta

SEQ ID NO: 78664 - DNA, 428 bp, Zea mays
  Clone ID: LIB3088-022-Q1-K1-E8
cccacgcgtccgcccacgcgtcctttgccttagccgcttcgcatcgcggacctagccccggcgccgatgcacgggtcggagctgcgcgtggcttaccagggcgtgcccggcgcgtacagcgagaaggcggccgggaaggcgtacccgggctgcgacgccatcccctgcgaccagttcgaggtggcgttccaggccgtggagctgtggatcgccgaccgcgccgtgctccccgtggagaactcgctgggcggcagcatccaccgcaactacgacctgctgctccggcaccggctccacatcgtcggggaggtgcagctccccgtgcaccactgcctgctggcgctgcccggggtgcgcaaggagtgcctgacccgcgtgatcagccacccgcaggcgctggcgcattgcgagcacacgctcacaggcat

SEQ ID NO: 78665 - DNA, 405 bp, Zea mays
  Clone ID: LIB3088-022-Q1-K1-F10
actacctccactttgtaaagaaataccataggtatgagaagaggcactccaacattcctgctcacatctcccgatgcttccgtgtgaaggaaggtgaccatgtcatcattggccagtgcaggcccctgtcaaaaactgtgaggttcaatgtcgttaaagtcattccagctggatccgcagctgctggaaagaaggccttcacagcagcctgagtttatagactatgttccatgagtagtctatagaatgatgtctttttaattcaaaagaaatctctcttctaggctggtgcttttcgactataatttggagattgttccgtgtccgtgcaatcatctgaacatgtgactacttattgtaccttgtcgtgcaaagttttgctaagatctctagtgtttcatggct

SEQ ID NO: 78666 - DNA, 250 bp, Zea mays
  unsure at all n locations
  Clone ID: LIB3088-022-Q1-K1-F11
cgnncggngaggcgccaggagngaggccgagggcagggaggagaaggacggacagnnggggggacgcagcgcaggagaggaacaagggacncaggagcnagggngangngagcngaaaaaaggcangngacgcaacgcaagagcagcggagcnncnaccccagcnncnnaaaccccccacaccagagaacaaaggagggcaaacgaacnaggaggcngnannganccancagcagcncncccgnnccgcg

SEQ ID NO: 78667 - DNA, 344 bp, Zea mays
  Clone ID: LIB3088-022-Q1-K1-F2
ctcgtccggaaccaatagggacgcttggtgaaaacatttgattagaaataagatcaaggggtgacagggatagttacaacgaacaggggcttcaagcagaagagaaggatgttgtgtcatctgtggccacagtgttatctgatctctgtggccctggagaatggatgcccatggcaaaactccacaacgagcttcttgagcagttctgcaacatgtggcaccccagcattgtccggaagtacctgacacatgacgactggtcttcgacggagactaatggcaggccttgtttcggccttctggcgcttctcaggaagtaccctgagcactttgtcatcaacact

SEQ ID NO: 78668 - DNA, 440 bp, Zea mays
  Clone ID: LIB3088-022-Q1-K1-F3
agaataccttgcgagtaccagaacaggaacctgtctgtacgcatcgacgaggaagggagccggcacccggcgcacctggccatcaccttcctgtaccagggcgggcagacggacatcgcggccgtcgagctctcgcacgcgcacgcgcagccgccgtcgtggcggcccatggcgcccgtgcgcaggcgcggcatcgtgacgtggcgcacctcaagcgcgccggcggggccgctgcagctccgcctcgtcgtcacggccggcgtcggcggcaagtggctgcgggccggcggggacgtgctgccggcggactggcggcctgggcaggtgcacgacacggggctccgggttcgcgacgtcgccctgagctcctgcacccgctcctgccgcggcgccgctacagccggcgccagcgaggagctcaggtagagtagattagatgt

SEQ ID NO: 78669 - DNA, 355 bp, Zea mays
  Clone ID: LIB3088-022-Q1-K1-F5
accggttcgaattcccgctcgacgcactcgtacgatgaatagtgtgaggactccattttggttttcacaatggacatgcttgcaaatgatggtgtccattctttcgcaatagggtttctgtaccattgctgatacatttttcttacacgatttcttcttttgcatcctttagcgttttaactaacaaagcagttcaatataatcaatcgcagccactgcatctaatccagaaacatcttaatcgcctcactgctgccgctacagattctccttttcgtaatcctcctaatctgacactcattataatgcacccctactacactctttcaattgcacaactacccaactataataa

SEQ ID NO: 78670 - DNA, 436 bp, Zea mays
  Clone ID: LIB3088-022-Q1-K1-F6
aacgcctaattttttttcgacatatatctggataatagccttgggacactatcatcatgcgttcgagggcaaaacagcatcgaccagtgacatgaaccggacacattaatagttaatacatacggtaggttgctagacacaaaggagcgaaccccttcctcaccgaaacgcagtcactcacatagcatgatagcataaacagcctatacattgccacgcgtacctcatttccaggccgggtacgagttgtcctgccggttgttcctgaacgcgcagcacccgacggagtagacgacgacgaggaagatcaggaagacgatgttgacggtggcgatcttcttccagtcgttcttcaggttggccagcacgcctgccttgcaggccatgcagtcgtagcagagcacggtctggtcgttcgaccatgtggtgcagtcag

SEQ ID NO: 78671 - DNA, 435 bp, Zea mays
  Clone ID: LIB3088-022-Q1-K1-F7
ggttaattgcatcctatcttctagatgcttaaagtggaatgagcgtgtcccctagagtggctgcccaggatatgaaagaaagccaagaagttaaagaagcactgagagcgcagatggaagtccaaagaagactgcatgaacaagtggaggtccaaaagcgcgtgcagatcagaatggaagcgtttcagaagtacatcgacagtatcctggagagcgcgtgcaagatggtcaccgaacagttcgcttcaagtggcttcagcatctctgaccctgatctcccggagatatcccctggaggggtggtcatgtgtggcggccccacggacacgttgagctcgtcggtgttcaaccagctttccgtcagctccatcggctcgcacagtccatgaggcaaaccttccccttccccatcatgcatggaatgtccgccgctgc

SEQ ID NO: 78672 - DNA, 373 bp, Zea mays
  Clone ID: LIB3088-022-Q1-K1-G11
agcttttgggactcaagcagagctatagcttcggatggcgtttcttctaacgctgctgcgaccgtggtggccgctgtcgccgtggctcagccccgctgcggcgtggttcatcttcttcaacgccgtcgtcagcgccattgccgtcatgtctaccagcggcagcggcggcgccggggccacgccgccgtcgcctcggcgcaggctctgccgcagcgggtcgtctatggtcctggatcgcctccggtccttgttcatttttcccgtggaggtggagcagctgccgatcgatgaaagcagcagtgctgccgcggcctcgcactgttgctgggcagaagcagaggcggcggccgcgactgagcgcagttcactggct

SEQ ID NO: 78673 - DNA, 430 bp, Zea mays
  Clone ID: LIB3088-022-Q1-K1-D6
cgttctcgtgccatcttcagcattcagtgttaaggaaggcacctactagaatacggaagggtgcacccagtggaccatgcgagccgttcctacggttggtgatgctagggatgactggaagatcatccgtgctctttccgacgttgctggagctctactgccttacgacagtctatcagctgtgacggaccggatcagtacggtcgcacctaatttagtacatgttgacgagagggagccattcacaatctccgtcgaggcgaagcctcctgtaaagcaaaaggtcagctcgacgccattcaaaactgcgttggagaacttctacatgactgatgcaatcactcgagcttctaagattatggcccaatgcactgcgacattgctgaagaagtgagatttgcacccttcgagctaatcttcagcaaacaac

SEQ ID NO: 78674 - DNA, 423 bp, Zea mays
  Clone ID: LIB3088-046-Q1-K1-D4
cccacgcgtccgcccacgcgtccgactagttctagatcgcgagcgagaggtatacgaagatgagcagcgctatgaagacgtatgggaagggcatcttcttctcgctgtgcgaatgggggaggcaaaaccctgctacctgggcaggcggcatggggaacagctggagaacgaccgatgatatcgccgacaactggggcagcatgacgtctcgtgcagaccagaacgacaggtgggcttcctacgccggacctggcgggtggaacgatcctgacatgcttgaggtgggcaacggcggcatgtccgaggcggagtaccgctctcacttcagcatctgggcaactggccaaggttcccttctgatcgggtgcgacgtgcgcgcgatgagccagcatacgatgggcatactcagcaactcggaagtca

SEQ ID NO: 78675 - DNA, 358 bp, Zea mays
  Clone ID: LIB3088-046-Q1-K1-D5
cggacgcgtgggcaagagccaaatcgccaaagtttggtcgttctaaaaacaggtccacaccagagactgaagaaaatgctaccgcggaccagcctgcccacctgagcctcgaggagaatgtttctcaaaccggtgtgaaaaaaccaaccccgttgaatccagcaaagaagccccagaggaagtcactccccagattgccatctgaagaaaccggtccgcttgatgccacctcaaggcagctaataaagagcgccaagctggatgcagttagtgctctggagacaggatcagctacaggacaggtacaactacaaggaagtgagacggaaacagattctggtcaggggccagttgaagc

SEQ ID NO: 78676 - DNA, 399 bp, Zea mays
  Clone ID: LIB3088-046-Q1-K1-D7
cccacgcgtccgaaactaggagtgctggcaggaaaagattggtatgtttatgctaccatattttttcaatgtttttattttctagcttttctttgaacttgcatggtaccatctattttcagattttgcaatatacttatcagctaagattcatgtagttctcttataatgctatataattagcacaatacagtgcactcagtttattatttcctgatgaaaagtgagtgatatagccactttatttggaggtttttacacaagatagcatgtaactgaaatactaagatagtatgaatcaataaatgcacatgctgaattggcttcgctggttagttttggctacaaacagataaggcaacaaattttctgagacagtaccttagcaacttgcatgat

SEQ ID NO: 78677 - DNA, 242 bp, Zea mays
  Clone ID: LIB3088-046-Q1-K1-D8
cggacgcagtgggcgcgacgtcgtgcgcaggacgccgtgggcaggactcttgcggatgaagacaagggacttaccgtcctacggagatcaatatgtccatcttaatgtcagcatccgcgaagatttaacgtgtagacagcggtagctgatcgaggaattacggaaagacgagcaaggatatcaccacaatgacgccaaggcagcagctggagcatcaccgggacagccggtcttaggagctc

SEQ ID NO: 78678 - DNA, 325 bp, Zea mays
  Clone ID: LIB3088-046-Q1-K1-E1
aaaaaaaaaaaaaaacataaaaaaataaaattaaaaaaaaaaaaaaaaaaaaaaaaaaaatggtaacatgaaaaaaaaaaaaaaaaaaaaaaataaaaaaaataaaaacataaataaaaaaaaaaaaaaaggggatgccgttttaaaggttccaagttaacattcatgtacttgcaacataatactttttaaataagcacactaaaattcaattaattgaccattttttaaaaaaaagtgaattgtaaaaaccctttatttcccaattttaacaccttataacaaaatacccattttccaagatggcataaaaccaaaaaggccc

SEQ ID NO: 78679 - DNA, 356 bp, Zea mays
  Clone ID: LIB3088-046-Q1-K1-E10
aaaaaaaaaaaaaaaaaaaaaaaaaaaaaataaaaaaaaaaaaaaaaaaaaaaaaaaaaaaggaaaataaaaataataaaaaaaaaaaaaataatataaaaaaaaaaatataaaataaaaaaaaaaataaaaaatttaacttataacaactctaaaaatggatttggtaaatcatgatccatgacgaaaatgatctaacttgataaataaaaagcttgctcttttatatattatgatttaacattttactaaaggtactttcaaatttgtaacatgttgaaattgtgatgaatctctaagatcacttgcatattagcgttgatgaattcagctctcattcaatcgtcacagttgaa

SEQ ID NO: 78680 - DNA, 397 bp, Zea mays
  Clone ID: LIB3088-046-Q1-K1-E11
gtcttgggagctatattcagcctgtggaaggagatgagggctgcaacgtcctgggaggacgttgagaacctggtctggggagagctgaaccggtaccaggactctgcagttcgctcagcataactaaacaccagcaaaaaaaaaaaaaaaactttctgaacatacgtgtatgttgtagttcctccgacgaatgtaacttccaaatataaaaaaaaagtgtagggaaaataacgaaggctcgacacggcatgcccgtattttcctatggctggcgataatattgagatccctgaaatggttctatgaaaaataaacaaaggccctgctgattggcaaaacaaaacagaacccatggatctacgagaagtaaacattgaaaagttttacatcaaacctt

SEQ ID NO: 78681 - DNA, 324 bp, Zea mays
  Clone ID: LIB3088-046-Q1-K1-E12
cccacgcgttcgcccacgcgtgcgcccacgcgtgcgcggacgcgtgggaaaagaaaaaaggaaaaaaaaaaaaaaaaaaaaaaaaaaaaaaaaaaaaaaaaaaaaaaaaaggaagaaaaaaataaaaagaaaataaaaataaaaaacaaatatagaaatgagataagataaagaaaagaagacaggaaggaaatgatctatgtcgatagatgaaaagcttgctgtctgagaaaacctggttgaagattatactaaaggtacttcaaaatatgccacatgttgaaattgggatgagtgtaaaggggcacttacatattagcgttg

SEQ ID NO: 78682 - DNA, 313 bp, Zea mays
  Clone ID: LIB3088-046-Q1-K1-E2
ctgtgatttgtatgtaccctgctcttcaataaagtagtgcccaaccatgttactgttacgccccaaggaaaggtgggtgactttgttagtgtaaaaaccagaagttttgaatctatgtatgttcattaattttgacaagaactcttatcattatgaaatgaataaaagggaaaatgatgtgttgtttgaaaaaaaaaaaatatgacaatataacacaaaccagaacgacaagtataattactacaaaaaaaactttctaattgaacgatctctgacatactatatatgagcaacagatgtatgtccgaagctt

SEQ ID NO: 78683 - DNA, 412 bp, Zea mays
  Clone ID: LIB3088-046-Q1-K1-E3
ggtggatcagccttatgtagaaggaaagtgcctaagttgtgcttgcccttctgtgcctagtactatatttcaagaagatccaattgaaccaaaaactggaataaaatttccaacatttctggaagacgactccagtccatctgcagcggtccttgttgggataggtttcaaaggcatgagagtgatgagggtcaaaaatctgaacctctacgcttttggtttatatatgcaaccgacttctatccgtgagaagctgggtcctaagtatgcttcatttccaactgacaagctgatggagaaccctgatttctatagtgatcttctcaggtatattgatgtatcattttcatcatatttctcagcttcttttgcttacccttaggttccatttgtaaaggagatttttgaatct

SEQ ID NO: 78684 - DNA, 111 bp, Zea mays
  Clone ID: LIB3088-046-Q1-K1-E4
ctgactcctgggaaaaaaaaaaaaaaaaataaaaaaaataaaaaaaaaaaaaaaacaaacgatcatatgtgaccttatcatacaaacacaaacatacaaaaacataaaata

SEQ ID NO: 78685 - DNA, 364 bp, Zea mays
  Clone ID: LIB3088-046-Q1-K1-E5
ccggcccggaacgaccgactcgacccactcgatcacccactacgtagacggacaacgtgcctcaacttgtgctccactttgtgtgcctagggctatagttcaccaaaaagcgataaacccgctaactggcatcaaatctgcaacattgctggaatacgactgcattccatctacatccatccttggctagataggatggaaaggcatcatagtgatgaggctcaaaaatctgaacctgtacgctaacgggatatatatgcaagcgacttctatccatcagaagctcggtcctaagaatgctgcattcgcaactgacaagctgatggacaaccctgaatcgcatagtgatcttttcagcatattg

SEQ ID NO: 78686 - DNA, 193 bp, Zea mays
  Clone ID: LIB3088-046-Q1-K1-E6
taaaaaaaaaaatacaataacattaaaaaataaaaaaaaaaaaaaaaaaaaacaggaacataggaatttttcatacgttcactatcttcaataccaaaattatcttatatcatcttacttaatttattttcactcaccctcttatcactttaaaatgaattgaccgtcactttacatactccatctcaataaa

SEQ ID NO: 78687 - DNA, 288 bp, Zea mays
  Clone ID: LIB3088-046-Q1-K1-E7
tcgcccacgcgtccgaccacgcgtccgtcaacaaagaggctatctggcccccaaggttctggggtaaacccgatggcccgtcagaactctggccctctacctcctgtacttcctacaactggcctaattacatcatgtcctatcacatctggtcagatgaattcgtctggtgctcaaaggaaagtatcaagccctcttgattctagcgcatcaatgaagattcgggttacctcttttgtacacaacccagtcgtcactaatatcaatgtaggagatggttactcgatt

SEQ ID NO: 78688 - DNA, 312 bp, Zea mays
  Clone ID: LIB3088-046-Q1-K1-E8
cggacacgtgagacgaattcgacacgcacaacgcaacgacaacgacaaagagatcgacgccgaatgtaaagaggagctgagggccatggaagcggagaaggcggaaatcgaccggactgcggcggctcggatgcatcgccagctgtggtgcgaactgacgtacctggtgatccaaacagccggattcatgcagatcaacttctgggagctgtattgggacgtgatggagcccatctgcttctacgtcacgtgacatgtacttcatgagcggatacgccttcttactccgcaccaagaaggaaccgtacgtcg

SEQ ID NO: 78689 - DNA, 433 bp, Zea mays
  unsure at all n locations
  Clone ID: LIB3088-046-Q1-K1-D3
cgcaactacatgatcctcgtcggcgcgggggcagtcgtcgtctgcgtcgcgctgtggaggatcatgttcggcatcgccagcaccttcgtcggcctctccgagggcatggccaagtacggcttcctcgccctagccaccgcccttgtcgcctttgccggtatgtatgcccgggcaaggttaaccataaaccctgacaaggtttaccggctggctatgacaaaactcaatacatctgctgcaatccttgaagttatgggtgcgcccctaactggtactgatgtcagagcatatgttatgtctggaggaagcccgaaacctgaagacttcaaatttaagcttggcagtaaacggtgctntctcattttccccatcaaaggatcagaaagaaggggtcttgtaagtgttgagttcaagaagaaaaagggacagtatg

SEQ ID NO: 78690 - DNA, 437 bp, Zea mays
  unsure at all n locations
  Clone ID: LIB3088-046-Q1-K1-E9
gctcaagcaggtgcacccggacattggcatctcgtccaaggccatgtccatcatgaactccttcatcaacgacatcttcgagaagctcgccgccgaggccgccaagctcgcccgctacaacaagaagcccaccatcacctcccgggagatccagacctcggtgcgcctcgtcctccccggcgagctcgccaagcacgccgtatccgaagggaccaaggcggttaccaagtttacatcctcttagggtgccgccgcacgttgctacgatcctgtttaattctcatatttaggcctgtgctaggttgcttctgcaacaatgtagaatttgttataattgctgaatgaatcagttacccctgttgaagtttctaatatattgtaatcttgctagtataatttgcttcaaacctggatggngtttccattcgtcgtttaaa

SEQ ID NO: 78691 - DNA, 441 bp, Zea mays
  Clone ID: LIB3088-046-Q1-K1-F10
cccacgcgtccgcggacgcgtgggagagagaagaggctgaaaggaaagctaatcttgatgctattgctgaaaagcagcgattgagagagatagagttggaggagaaggcaaaggcgaatagggagaagctcttaaaggggtctgaggcaggtgctgctccctcttctaataaatatattcccaaatttaaaaggcaagatggtcttcctgcacgacaggatgcacccccaccccgccaagatggccctcctccgtctactgaccgctggcgtccatcaagatattcctcaacctcttcgtcaacctgggggcgggcacataactgatcctttttttttattttgctgactacatttataattttggagcttgtctcataggctatcgcaccttaccgttcactatactccatgcatattgtcggtagttgctgactgcatt

SEQ ID NO: 78692 - DNA, 208 bp, Zea mays
  Clone ID: LIB3088-046-Q1-K1-B6
cccacgcgtccgcccacgcgttcggttatattgtctatctatttgtgtgaagggagatggccttgatggatggattagcttcgctaatgctttagtttgttgctgctgctgcttccgtttgctactgatgatgcttttactgtattttactactttagtttgctcgacaaactattgtgatgatggataaagtgtgttgtgatggtgg

SEQ ID NO: 78693 - DNA, 274 bp, Zea mays
  Clone ID: LIB3088-046-Q1-K1-B7
ccgacgcgagcagccacgcgtccgcaagtctggaatgaactagtgacatgtgaacaggacgatgatcgacataatcaggggaccaaaagggatggacctgacgcaggaataaactacagagaagatgaagagggattacaaaccagagcggatgatgctatgactgagattatactacctggactttatctcgtacttctggtctagtacatgccatcatcggttgctggactgctaagtggactatagtgcattgatggtctccacgctatgc

SEQ ID NO: 78694 - DNA, 424 bp, Zea mays
  Clone ID: LIB3088-046-Q1-K1-B8
gagcaccgtcgcggcccttaggtcactgaaggagatccggggcaagagctgtactgtcagtatgttctcgttgccacctcttcagggcaacaatgcacaggacagctaccagatccgggcagagcaactagatgaggagccggagaggtggagcaaagtaacagtgatagagcaggcggccaaatgacagaccgaatgggcaaaacatctgatggctgaacttaaaaattttagacttggacatttgctggagatgggactgggatcccaatctcccattcagaaatttgtatgaattcaggattcctaacagctgcaaaatggtggacatgttaaatcatagaattcccagcacaaccatcggacagaattgggctgattttattcactattgtgaattgatcatgtgtttttactgatatac

SEQ ID NO: 78695 - DNA, 422 bp, Zea mays
  Clone ID: LIB3088-046-Q1-K1-B9
gcaaggtctcttccatccagcaaggaaagtacgagaagtgtattggaagatggcaactggttgtacatcggcgcgcaggatgcacttgttgcttcttatcctgccctggaagacgatggggataacatctttagtcgtccagagttggcaatgtttgtctgattaacggtacctcatgttgcagctgctgaagcgttacactggatttaggaccaatcctaaggctgcagcatgccaattaatccatcaagatcctatattgtgaaggacaaatgacaatcctagcgcgctgtcatctttttatgaatattacgcgttgggcatttaccgtgttttaaaactttgtattacacatggatgttgtattatgtggtgtggacaatggaacgttgcaagctgacctgaacctgattccttactgg

SEQ ID NO: 78696 - DNA, 433 bp, Zea mays
  Clone ID: LIB3088-046-Q1-K1-C1
caaattccaacctatgtgaagcagtttagctcccttaatcctaccaagtaagttctctcgaaaaaaagagacacttccaattttaatgcatatgtaaacctacaaaagatgttcatgtaggaccatcaactccaaaaaattattagtaatgtctttactacaagaatcaccctccatgtccatgcataaactatcaacaaccacacctcaaaggcaagttccttcaaatttatacccgtacaatctaacacttacttaataccaacttaaatattatataaaaaatataacaaatttattatgtacaacaggtttctagagcattagcctaccatgcatgtcaagaaaacacaccagagtatttcaattttacttcgccctcttttttaacataatatacatatcactggtttttagcataccacctcatgct

SEQ ID NO: 78697 - DNA, 437 bp, Zea mays
  Clone ID: LIB3088-046-Q1-K1-C10
ctggctcttaacaaattcctacagaaggtatgtatgtggcttctctaatttggatctgttgcgcatttaggaattaggattagatgattagtggattactcactcagacaaacatcttctgcaacaggcaatttttctgtttcataatcaactgggtctgatatgtctcataccaactaatggccgtgagaatgttatttaggcttatataagttatacagaagatatttcgttatgataatgcacaaaagttatggtgtgcaatgaaaggtgcaaaatgtgttttccaccctggataggggtcgtggatttctaagtcttgacgaggtgtaccaggcattaatcaaacttggtttctcggtggattcaccaggcttctatacttgttgggagagctttgacaagagcaagaaaggcatgattcaattggatgagtt

SEQ ID NO: 78698 - DNA, 180 bp, Zea mays
  Clone ID: LIB3088-046-Q1-K1-C11
cccacgcgtccgcccacgcgtccgcttatatttgctggaacatgaataaaagggtctccagctggtactgcttagctcttacaggaaaacaatgggagagactttggacttcctgacctaaattaagcattgcgcatggagaaccttatatttgctggaacatgaataaaagcatttgac

SEQ ID NO: 78699 - DNA, 356 bp, Zea mays
  Clone ID: LIB3088-046-Q1-K1-C12
acagttctagatcgcgagcggccaccttttttttttttatattttttttttttatgggtttttgggaattttttttttatatttttatttactatattattttatttatattttttgaatttatttgatttttaatacttacaattttaatgttctctaagtgttaacaacgactaaaaatgataattacttaaaccaatcataagaatctgatagacataatcaaaagttcattaaataagattttgatatatacacaatcgctataaattaagacttgagaatatagctagattatgatcatcagatacaagactcagctagcaccatatttaaagctgaatacccagtttttc

SEQ ID NO: 78700 - DNA, 240 bp, Zea mays
  Clone ID: LIB3088-046-Q1-K1-C3
acgagataggagcctgtgttcttgtcccagtataagatctgcgatggcacgatgcttgtgccatctgtttcttcggtgacttatttttatcatgcagtgcatgtgacttgaaactgtgatggacttgtattgctttctgccttatggcacctgtagtagtgaactgatgaaggaagttcatgcggactctgaagctttgttggcttagaatggtaattttgctgtattctatttcacagg

SEQ ID NO: 78701 - DNA, 332 bp, Zea mays
  Clone ID: LIB3088-046-Q1-K1-C4
aaaccagtgtgtgtcattattacaaaacgaacatgcatgttctgtgtctgaaacaaagaggctaatgggctatacagaaaagctgatgaagctgaaccgacgacactacacgtcttgatcacatgaaaataaacgctgcaagaatgtacagattgaatattgacgattttggctctgaaaattaggacacaaacctggaatggcatgctctaatttgtaacccatgggatattgtatttgtatgccaatatttcctcaaacgtaaacgaaattgtaaattcatggccacattttacaaacctgtgacggtataaacccttgtgttacccaaa

SEQ ID NO: 78702 - DNA, 240 bp, Zea mays
  Clone ID: LIB3088-046-Q1-K1-C5
acgagataggagcctgtgttcttgtcccagtataagatctgcgatggcacgatgcttgtgccatctgggtcttcggtgacttatttttatcatgcagtgcatgtgacttgaaactgtgatggacttgtattgctttctgccttatggcacctgtagtagtgaactgatgaaggaagttcatgcggactctgaagctttgttggcttagaatggtaattttgctgtattctatttcacagg

SEQ ID NO: 78703 - DNA, 245 bp, Zea mays
  Clone ID: LIB3088-046-Q1-K1-C7
tcggacactcgtccggaagattcccgtttaaaaactgcaatggcacaaatgcttgagccatctgtgtcttaaagagacttatttatatcatgcaaaagcatgtgactcgaaacttttatagactcgaattgctttctgccttaatgcaactgtataattgaacttatgaacgaagatcatgcagactctgaagctttgttaccttataatggacattaaaccgtattctattccacaagaaataa

SEQ ID NO: 78704 - DNA, 232 bp, Zea mays
  Clone ID: LIB3088-046-Q1-K1-C8
cttagtatgaattagattcagctgcataatgcctgtcacttgcgtacttccatgtaagggaattctcaaaaggaagcaaaatcttgcccaaaaaaaaaaaaaaaaaaaaaaaacaaaaaaaaaaaaaaaaaaaaaaaaaatacaaaaaaataaaatccaaaaaaaatctcatgaacatacaaaattcattagctaacattataagaaacccatatcataccaaccacacata

SEQ ID NO: 78705 - DNA, 415 bp, Zea mays
  Clone ID: LIB3088-046-Q1-K1-C9
cagatatgcttgcaacgtgaaatggctcgttgtgagaggaggtgatctgcatgttatccgggaaggcgcgtttcaagagctgaagccacgtgatctgcagattgccaaaggcttgatatcgtcaaagttcctgcatgagagtcacagagctgagctggcgctgatggtggagaggggcaagcgtgcacacatcgaagccctctactcccacgggttctgtttcttggggaagtacatcgcgagaaagatcgtgcagggctattacatatgacgattggccgctggaatgttagcatggttgcacggaacaatgagctgcatggactgtaatacagtagctatatatgtccaaccgcctgtaaactgaaacgatggtctgtatgggaatgtatataaatacagcatgagattagct

SEQ ID NO: 78706 - DNA, 298 bp, Zea mays
  Clone ID: LIB3088-046-Q1-K1-D1
caaattctgatcttgagcttactatccaaataacttaatactaccaagtaagtaaataagggaaaaaagggacacttgcaataataatgcataatgtaaaactacaaaaaagggcgatgtatgaacatgatcctagcttaaattctcagtcatgccactactacactaatcactctggatgcccatgcgtaaactattggcaaccacatttcaacggcaagactgttaaaacctatacccttccaatctaacacttacttcataccaacttacatattatatctgacatattaccgat

SEQ ID NO: 78707 - DNA, 441 bp, Zea mays
  Clone ID: LIB3088-046-Q1-K1-B4
aaaaaaaaaaaaaaacataaaaaaaaaaaattaaaaataaaaaaaaaaaaaaaaaaaaaaagactaacggtataatttaaaaagacaactattaaaaacaacaatacacaaaacaaactaccaaatccaatcagatacaactagataaaagaaccgaaacagtaaaggcacagtcacatttatagaccaagcttccaaatgacagaccgaatgggcaaaacatctgatggctgaactcaaaaattttatacttggacatttgctgtagatggcactggtatcccaatctctcattcacaaatttgtatgaattcaggatttctaacagctgcaaaatggtggacatgttaaatcatacaattcccaacacacccatctgacagaattgggctgattttattcactattgtcaattcgatcatgtgtctttactgatataca

SEQ ID NO: 78708 - DNA, 328 bp, Zea mays
  Clone ID: LIB3088-046-Q1-K1-D10
gcggtttagctgagacgccattgggctccatgtgctggcgccttgttaactcacagagcgcgtgggggctgaatctgtttgagcagcctacttgcaatcatcctgagctgatgctgtgctgctggtgcatgctatactatcattacttatcggctccgctgtagcttcttacccaccggtgacattagttcggtacccgtatctggatatttttttagccttcttcgttggattgttcaccggtgatggcatgtattaacagacatagttacatacagatgtaatgaattcatgtctggatcatattgctttcagttgcacaaattaa

SEQ ID NO: 78709 - DNA, 434 bp, Zea mays
  Clone ID: LIB3088-046-Q1-K1-D11
atttgggcgtggtgattatctacttgatggctatgactatccaagctacatggatgcacaggaccgtgaggatgcagcctacaaggataagaagaagtaggaccaagatgtccatcttgaacacagatggtagtgtcaaattcagtagctatcgggccatcagcctgtatgcctaggtgatatgggacatcaaggctagccctgtcgtgtgaacgtgtagattgcgattgatcacctaacgtagcatgttagggtgctattatagtatggaggaatcttgacccactgagcttgacgcccacttagcaatgtaggcattgaacaagaggcacctatctcgatctacagcgctgtgtattacgaattggtgcgactatgttgctctattttcctcaggcttatatcttatgaaacatgatacttttgatctgtgc

SEQ ID NO: 78710 - DNA, 192 bp, Zea mays
  Clone ID: LIB3088-046-Q1-K1-D12
gatgccgtaatgtactattcgcctaaataagaggacgcctcgtctcaactctgagaaaacgagtgcttctgtgatggtaattcgtatgagagagtgccccctttggtggcacttcttcgtatgtagtattaactcctgtcttaatatgtcgccctgcttgtgcttttcataccatgtttgctctttcagctg

SEQ ID NO: 78711 - DNA, 232 bp, Zea mays
  Clone ID: LIB3088-046-Q1-K1-D2
tgaactcaaaccatcttatgagggtcaaacctgtttctaatttctaaaaaaaaaaaaaagaaaaaaggaaaataaaaaaaaaaaaaaaaaaaaaaaaaaaaaaaaaaaaataaaaaaaaaaaaaaaaaaaaaaataaaaaaaaataaaaaataaaaaaaaataaaataataacaaaagaagcccaaaacgatcgacacttaacaacaggtgcgcaaccttaatggagaatgg

SEQ ID NO: 78712 - DNA, 439 bp, Zea mays
  unsure at all n locations
  Clone ID: LIB3088-046-Q1-K1-A10
gcagtgcagtgcagcagtgtgctacctcctcagtcctctcactccatcacaaacgctagtgcttcctctaaagctcggagcgagtctcagaagcgatggcgtccaagaggctgctgctggcggcgctgtgcgtggtggcggcggcgctgctcgccgtgcggtcggaggcccacggcctggaggacttcgcaagcagcgacgcgacgccggagatgcagaccttcttcaagcccgaggccgcggcgctcccggaggccctggacgcgtcctccatgcccgccgccaccatggccgcgaagccggaggccacgtcgatcccgaccaccaccaccggcaccacggcggcggcggcgggcaccttcgccgcggcaggcactactgctgcgtcgccgccgcgcaggtccgtgtccgtggccgncggcgtggcctgcggcgtggc

SEQ ID NO: 78713 - DNA, 440 bp, Zea mays
  Clone ID: LIB3088-046-Q1-K1-A11
cccacgcgtccgcccacgcgtccgaatgactagtcaatgtgaagcccttggatggggcacgaggaagaagctatcgagctggcttgtcaatggacacgaatcaaccccggacaatcctatgccaagccttcccactgcccatcattccatcattcccaaggtaaaccctgccacgttccgcacatcatctgaatcatgttctgcagtaaagctcccacctgccagccccttcgataacttcctgaaggctgcctatcgcacccagcccgagctgtgatcgatttacctaagaacaaccctcttcacgagtgctaggctgcagtaccaaagcatagggtactagattatctaaaggaacttatctatgacgttgttttagttgtagtagcgtaactatgtgtatctatctactagatgtctgtaacgtttgcatatgtatc

SEQ ID NO: 78714 - DNA, 324 bp, Zea mays
  Clone ID: LIB3088-046-Q1-K1-A12
atatgacacaggttcgaatacagcgagcacaactgcattctcagcattgaatgcagcaagggcaacccgccacgggactacgggagcgctgccacgacgacctaccataactacttgcactgcagcgtaagtagatcaacgtctacagatatcacgcgcatcgacgatccaagaacaacagcagcaacatgaattgcataggagacctcaccatcacatcatgaggaagcctctgctgactcaatagctaaattactgacaccatgcatgcatgccatatcactatgaatggtccagcggtacccctaccatgcgtgcctttta

SEQ ID NO: 78715 - DNA, 438 bp, Zea mays
  Clone ID: LIB3088-046-Q1-K1-A2
tggccggccaccgatgatgcattacccaatgcccccgcactcgcaccccgagccatacaacatcttcagcgacgagaaccccaacagcacctgctcactcatgtgatcagcatatcgtctcttgctgccctgttccaagtaaaaaaaaatctgaaggagctcaataccgctggccgccggcggacgtccgccatggttgaagcgccgtccgtgaatcaatcataaatcagtgtgcttggttgggggggatgatcgtagctagaatctgccccttttcctcctcccgtttcacctttttctctacgcttattttcgccttcctttcagaaaaaaagaacttccttgaatgcgaagtttggtatagtaattatgaatagtttccataagggaggagatggtggggccttcttcatagccaacccacccaatagggggggg

SEQ ID NO: 78716 - DNA, 253 bp, Zea mays
  Clone ID: LIB3088-046-Q1-K1-A3
cggacgcgtgggaaaaaaaaaaaaaaaaatacaaaaattaaaaaaaaacaaaaaaaaaagaggaaaaggagggctgtaaagaagggtcgtatgttctataacatccacgtttatatgcgcttctatgcgatgctatagtgtctcctatgtacactccaaaagcccatagttttagcacgcttttttacagcgaaaaccattgggaaaaccctgcttattcccatcttagtacattcgcattacatccgctttt

SEQ ID NO: 78717 - DNA, 345 bp, Zea mays
  Clone ID: LIB3088-046-Q1-K1-A4
agaacatgcgaagaagcaatgctcttatgttggatcgtgagatgaccgtgccttgggactggaacctgaggttgcaatcgtgcatttcccctgggatgttggatgatcttgaggcatgcgagcctgtcgttgaagatgcaaggttacctacttgtacgacgtacgccaatgcgacctgtgtagctgtgagtagtctaatgttgcagtgacatgtaatggcgcacccccgtcctactaacagatgcttactggagattgccatagctgatcttgtaatttgttatagggcagtatgaatatatttatggtagcttgaatctatttgtggattcacttcgtttttcc

SEQ ID NO: 78718 - DNA, 426 bp, Zea mays
  Clone ID: LIB3088-046-Q1-K1-A5
cggacgcgtgggcagcacatggctagaccttggtgatgacatttttgaagagttgggggaatcaagatattttcatcgcaggcgacatggttcgatcagagtaagccagtattcaagatcccggattagggagcatcgccgtgctgtttttgatagtggtaatgaacaaagcactgctgcatgtcctttggggattcatcaaactggccgatgcacctgtgattctttcttggttgctgaagaatctagtgcccgagcaagtatatcaagaattgtcatgttaactgaggcgttatttgaggtgttggatgaaattcaccgtcaacctgcatcactttcactttccatggtctctgttcaggctcctgaatctgtagtcaattcgttgccatgcaagagctacaaaaagcttgaggcaccccaacg

SEQ ID NO: 78719 - DNA, 358 bp, Zea mays
  Clone ID: LIB3088-046-Q1-K1-A6
ggcaagggagaacgaggcgctgcggttggagctggcgcggatgcgagcgtacgtgtcagggatgcagcagagcagcaaggggagcgggtcgaggccatcgtcgtcatcgctggtaccaggcccagcgacggcgacggggaagaaggcaagcttcttagggtcggtgtcgcggacgttgagccggctgaacccgtttaagggcgggtgggccaaggacacgaccagcattgccgatgggcgagacaggacttgcatgcatgtggtgaagcccaagaggaggaagttctgcatcggctaattcttttgtgaaatatcgatatggaacgggtatcgcgtgtgtgacttatattaaatcact

SEQ ID NO: 78720 - DNA, 354 bp, Zea mays
  Clone ID: LIB3088-046-Q1-K1-A8
gcaaaccagattaatttattcgtacagcataaagacagaataagacaccatttacaagccactgaatatgtatagtgatccactggcgcagaagtcagattcaagattcatttcgtctataaaaagtagtttccagaaaaaaaaaaagaaaaaaaaacaccaatgcaacctgaagaaaactgagaataaactaatgatgcaaagacatggaaatggctcaccaggagtcctagttacagatgcttactggagattgcatacttgatcttgttgttagttatatggcattctgtagatatccatgagtaacttgaatctatctgaagattcaactggactgaccggaaaaacctt

SEQ ID NO: 78721 - DNA, 433 bp, Zea mays
  Clone ID: LIB3088-046-Q1-K1-A9
caactttggctgaagatgcccatttggaatggccgctgtgccattatgccttggctagtgctctgggctagtcagaggtgtggggtagcggcgtcaaccaagtcatggttgagtcccattggtctggtctcagggagttgtcatgtcagtcccagtcagcagggtcagtccttgggctgcattaccagtggtgcagcttggtcggtggtcagtcttgaaggtcagccggttggatcatttgggctcttgctcccaccagcaccacctctggtgggaggcatcaggcatggagtcgcgggtgttgtcaggagttgggttttgcctcctatacagcataaatgaattatattgttttacctgttggtagaaagaaccttgaaagatagggaacgtgtcgttttttgtcaaagcggttcctgtgctgtataacatg

SEQ ID NO: 78722 - DNA, 173 bp, Zea mays
  Clone ID: LIB3088-046-Q1-K1-B1
attacgcgaatcaactcacctacaaatctttaacccaagtgattcgctggcgacctcttgccaaatcaaaatgggatgaatcttctcatgccacttttatcttattcaaggcgctactaagcatcaatgctagggggtaaataaaataacggggaagaggagatgtcacgatt

SEQ ID NO: 78723 - DNA, 416 bp, Zea mays
  Clone ID: LIB3088-046-Q1-K1-B10
cccgatttatcaggaacagggaaagtaacttccgtaaaattcggagtagacgcgaaatacatagccataggttctatggaccgcaatctacggatatttggtctccctggagatgatcaaatggaggaatcaaacacagcggccgagtgatgggaattcatggtgcctaatttgtttcttctgccatcatcctcattatactgtggtgatggatagactgattgcacatggatacatcaccgtcacaagagggaagggtcctggcggggattactggtctgagcttcggctggtgtaaaacaagctgtgatattgttgtactgtaagccttactaattcttctgatgaggatacaatttgttttgttgactacgatgctaaacagctaaagttctctgcgcagattccagtgattc

SEQ ID NO: 78724 - DNA, 435 bp, Zea mays
  Clone ID: LIB3088-046-Q1-K1-B11
cccacgcgtccgctccaactccaccgctcctccctcttcgttccctccgatcgcgcccctataaatccagtcgcctcagccgccacagcgggccgcaagcacgcaaccacacagctcactgctgctcccgtcttcccgtgtcctgtcgtgctcccgtcgccgggggcggaagggttcgcgaggccggcgggcggttagggatttctccggagtcccgcgatggcgaagctgtacgtgcaggcgttcccgcccgcggatctgaacaagaacaccgagtggttcatgtatccgggcgtctggacgacctacatcctcattgtcttcttctcctggctcctcgtcctctccgtcttcggctgcacccctggcaccgcgtggaccgtcgtcaacctcttccacttcgcgatcacataccactttttccattggaagaaa

SEQ ID NO: 78725 - DNA, 439 bp, Zea mays
  Clone ID: LIB3088-046-Q1-K1-B12
cccacgcgtccggcaaaccaaacatgcgtgattcttcgtttacattgacgttaccgtggtgcatttaatttactgcacagaaaatctaaagacgccagttcccaacattatgcatgaagggaactagtactggtgaaggccggagattgatattctggatcagctacttgtcattgctgacccccgcaagaaggggctccgtcgtcttgttagcctaccacttgtgcaacctattctgtgcttcctctacctccttgttccagtcagttctcaaggtgacccacactagaatagccgtctgcatgcaggtccctccgatcatcccagcccaaatgcccttaacaccgagcttgaagacgaacccgagcacggcgccgagggggacgccgactatgtagtagcagccaatgttcacgtaagccacgaactgctgtcaccc

SEQ ID NO: 78726 - DNA, 441 bp, Zea mays
  Clone ID: LIB3088-046-Q1-K1-B3
cccacgcgtccggcgacccgtaccccgcctcccggttcaaccaaatccctctcgcctcagccccaccagcgcaaagccgtcctatcgtcctgtcgtgagaagcaatggcgggccgtggcaaggcgattgacgctggtgccgcgaagaaggcgacgtcaaggagctccaaggctgggctgcagtttcccgtaggcaggatcgctcggttcctcaaggccggcaagtacgccgagcgcgtggtcgccagcgcccctgtctacctcgccggtgtcctcgagtacctagccggtgaggtcctgcagcttgctgggaacgcagcgagggattacaagaagacccgcatcgtgccgcgtcacatccagcttgccgagcgcaacgacgaggagctgaccaagctgcttggtggtgccaccatctcgagcggaggtgttatgccccccc

SEQ ID NO: 78727 - DNA, 433 bp, Zea mays
  unsure at all n locations
  Clone ID: LIB3088-046-Q1-K1-A1
tgatattgaaggacgcccggttatggtggttgttggtgcacactttcttcttcgatgccgtgaccttgaacggtttgttcttcatgtagtgaaggagtttgaacctttgattcagaagccatatacaattgtatatttccactccgcagcatcattacaaccgcaaccagatttaggatttatgaagcggttacaacaaatactaggacggaaacatcagcgcaaccttcatgcaatttatgtactccacccaacgttgggtttgagaacagctgttttggcaatgcaaatgtttgtagatggagaggtctggaagaaagttgtatatgtggataggcttgtgcagctgttcagatatgtaccacgcgagcaacttacaattcctgactttgnttttcagcacgatctggangtgaatggtgggaggggccta

SEQ ID NO: 78728 - DNA, 438 bp, Zea mays
  unsure at all n locations
  Clone ID: LIB3088-030-Q1-K1-D10
ctcgatgaaaagcctttccaaaatgcatgtaagacaaaatacggaaaggatgattacgagatcagagcagcagagctggtcgcaagttggcaggatgaactaaagaagccatcctggcatccttttaagatggttgaggttaacggagaaaataaggaaattctggatgacgatgacacaaaactgaagttcctgtggatcgagtacggtgatgatgtgtgcaatgcggtgaagaccgcactgatggagatcaacgagtataaccccagcgggaggtatgttgtgccggagctctggaacttcaggaaaggccggaaggcgacggtgaaggaggtgctcaagtacctgttcagtcagatggacacgacgacgaagcgcangatgggctgaggaagtgccttctatgtngttgcatcagtcgtgtgctgctcgatcccc

SEQ ID NO: 78729 - DNA, 446 bp, Zea mays
  Clone ID: LIB3088-030-Q1-K1-D11
gcggcaacttggtggggatgggaatcattgctctgtgcttcaaagctggtgaggatgctgatgtcctgggcctcagtggacatgagcggtacatcatcgatctccctaccaacctcagtgagatccgtcccggccaggatgtgactgttactaccgacaatgggaaatctttcacttgcatcgttcgctttgacactgaggtggagctggcgtacttcaaccatggaggcatcctcccttatgtcatccgcaacttggcagctgcgcataactgaggcaaggtcaacacaccgtttgacccacaatggcagtggcaggctccatgttcccagggctagcgacctggttctcaatgtagtgacatttgtgatggatctaggggtctctttgtcgattcagcccataaataaagtgtgaaataaaagccgcaggtggaggcaggaacc

SEQ ID NO: 78730 - DNA, 323 bp, Zea mays
  Clone ID: LIB3088-030-Q1-K1-D12
tcgcccacgcgttccgggaccccttggtttgaccaaggttaagaccgccaccaaggttaccgggtcctaaaccctgggctggggcggcttctccggccttgtttgccactgctatcctgtgatctgccctgagtggctcctatcgtgtaatgtttctgtcggttcttatctatctgtcgttgtgtggtttacaacttacgttgtaagactttattcccccgctttgctactgggttattaagtttggcgttattgtttaaaaaaaaaaaaaaaataaaataaaaaaaaaaaaataaaaaaaaaattaaaaataaaaatataaa

SEQ ID NO: 78731 - DNA, 271 bp, Zea mays
  unsure at all n locations
  Clone ID: LIB3088-030-Q1-K1-D2
tgtcacactttatcctacgcaagcacactgntctgaactgggagagaagaataccatcgcgcgacgggattacaatattagggagtagagcacntactgttggccataaagacggcacaagaatggtgaccttataagagctatgatgatgcttcctccaaaaaagataccaccatctctgcacacgcatatactgactgtgctgaatgatacaatggtgcgccaaactgctatcgacgttaaatgtgtgctgctgatgtactacaagaac

SEQ ID NO: 78732 - DNA, 256 bp, Zea mays
  Clone ID: LIB3088-030-Q1-K1-D3
tccgttccaacttcaaatgcctgaccaacatctgcgactcggtcttctcccgcgtggtggtcgactactgccctctcttccccacgggccgcgtcgtctgggaggtgcgcgtggactgtaccgtcgcgctcaagtggtcccgcggcctggtgctggccgtgacctcgtcgacgctcttcgcggggctcacggtgcggcatgacgaccgctgcacctgccagtcgttgacgccgaccaacgttaccgcgccccttga

SEQ ID NO: 78733 - DNA, 428 bp, Zea mays
  Clone ID: LIB3088-030-Q1-K1-D5
accgaatcatgttgttatgtacatgcctgaggtttcaaaaacacatatgggaaacacgatgaggttgggctgcaggagaacattcttcagcaaacctgattgtcttacatcaaaattgtacggaagtcctccacatgtagatgagcgtcatcgtcatagatacgaggtcaatccctcttttgttcccatgcttgaaagtgctggtcttcattttgttggttgtgacgaaagtcgaaaccggatggagattgtggagctacaagatcatcccttctatgtaggtgttcagttccacccggagttcaaatcaaggcctcgaagaccttcacctccttttacaggtctaataatggcggccactaaacaactgggagcaatttcgaatagctcgaatggctacgttggagcttctgactaatatggggatc

SEQ ID NO: 78734 - DNA, 400 bp, Zea mays
  Clone ID: LIB3088-030-Q1-K1-D7
ccatgttgctgaagttttcacgggtgcacctggaaagtacgttgagctgaaggagagtgtgtaaaagttggcagggggttttggatggcaagtatgatgaccttccagaacagtcattctacatggttggaggaatagaggaggtcatcgccaaggcagagaagattgccaaggaatctgcatcataaggggtctacaggcaacgcaaaatttaacttttggaggtcaacgtgatgtgctttttatcctgtgttatcaagaacttacgtgcaggagaccctgccctgcagaaggatgtttctctcctccgtccccccaccccacaccccaaaataaggattcgcagtgacattttaatttggtttactgccctttgaagaagaattacctttttttgatg

SEQ ID NO: 78735 - DNA, 269 bp, Zea mays
  Clone ID: LIB3088-030-Q1-K1-D8
cccacgcgtccgcagtatgtatttttgccttgcgatgcagtcccataagtattgctcccgccaaaaaaaaaaaggggaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttaaaaaaaacaaaattaacttacccgggcttgaaaaataaaaatttttttaattgggaaccaaa

SEQ ID NO: 78736 - DNA, 322 bp, Zea mays
  Clone ID: LIB3088-030-Q1-K1-E1
cggacgcgtgggggcggcggcagctgctgctcatgcagttgcagaggcagaggctatcagggcaggagctgaagcagctggtagggaagcataagctgcggaagcagaggcccgagctgcacaggcctttgctgaagcagcagttttgacactgaagaacagaaatgctgcgaaattggtatagctcgagtccatgaatcttagatatgccctcttgtccttccacacgtagaatccagttccgtagctctgtatgcaactaattggttactaaaagaacctgaaatcagaagttttcacaaacacaccgacttattcaccg

SEQ ID NO: 78737 - DNA, 153 bp, Zea mays
  Clone ID: LIB3088-030-Q1-K1-E2
aaaaaaaaaaaaaaaaaaaaaaaaaaaaaaaaaaaaaaaaatttaaaaaaaaaaaaaaaataaaaattatataaaaatatatatattaaattaaaatatatttaaaaaaaataaaaaatttaatttctttttcccttcatttaaaaattataa

SEQ ID NO: 78738 - DNA, 346 bp, Zea mays
  unsure at all n locations
  Clone ID: LIB3088-030-Q1-K1-E8
cccactctttccttatcttcctccttattatcctgactggtactacatcatggctgcatggatttcaaggaagagctacctaangcaangcattcttgtggatagctttcataagatctacagtggccgccagaggaatggctacctcccaccacacttctgcaatagcagtggtgctgttgcacgcaacatcctgcatctgctgcagattatgggcatcatcgatgtcgatcccaagggtggacgcctcatcaccaaccatcgaaagcatgatcttgaccaagtggctggaagggtcgctgctgaagcatgagcagtgtcatctgtggtttcaatggtgtcatgt

SEQ ID NO: 78739 - DNA, 278 bp, Zea mays
  Clone ID: LIB3088-030-Q1-K1-E9
tctccactcgtccgaaaaaaaaaaattaaaattaaaaaaaaaaaaaaaaaaaaaaaagtaattgttaaattagaaaagggggtaggaaaaaatacttaatttatttataataaataaaaaaaaataaaaaattttcttgccactctttattttttttttttttcgttttttttttaatctttcttcttttatatccatttggttttcttttttattcccttttcttattttatttattttgctttataaaaatcttctttttaaaaccttttcttttt

SEQ ID NO: 78740 - DNA, 304 bp, Zea mays
  Clone ID: LIB3088-030-Q1-K1-F1
attgggcgcctgcaattcttccaattgagatcatattaatcggccagctggctatcttgtgtgtggctcaataggtcacagcaatggctatcattatgctacctgatgccttcaaagctgtacttacatgtgacaacagtggtgaatttaataacattcatgttgttcttgcggggctaacaaatacatattcgcagtatattacaacttttgaagaatatgagatccaaagataccacggagcgttgaccttgtatggcccccacacattgagcgcctacattcacgagtttcagaaacttgc

SEQ ID NO: 78741 - DNA, 431 bp, Zea mays
  unsure at all n locations
  Clone ID: LIB3088-030-Q1-K1-F11
agctcgcccgctacagggtttcaaatggaagagatccgcacgaactgatcgaggaggaggagcttatgaggaggaaactggacgagagctaacgagatagaagccagctggcggaaaacctatcaagcctatgctccagcattctgaaggtcgctggagtttcggactcagcatctgacgcaactcttttgaaagcatcggagtgcttggatcagctccagtgccgtatcgcttctttggaaggccaagttgaggatctaaatctaaagtgcaaactagtgcgtgaaaaggcccgcctgtccgagctccggagcaactcgtcgtctctgcgcacaggggcgaagggcaatctgacatcgcccagtccggacacatcgncaagcatttcgtccttccgatgacacaagcggacggatacatcggcgagaagc

SEQ ID NO: 78742 - DNA, 247 bp, Zea mays
  unsure at all n locations
  Clone ID: LIB3088-030-Q1-K1-F3
cccacgcgttcgcccacgcgttcgggtggatcgcttggtcaaggtccgtgtgctttaaagacccagcttcagtggcagtgagtgtggctgcttgtgtangctttggtacgtacgggctttatttgcttccaagtcagggtctggatgttgtgtactacttgggtttgtcgaattattatgagcagttgcgtattgtaattcagctgggctacctggacattgttatgtattaataaatgctttgctt

SEQ ID NO: 78743 - DNA, 403 bp, Zea mays
  Clone ID: LIB3088-030-Q1-K1-F5
gctcccacgcgtccgctatctgccgctccagcctttcgctagggtttatccaccggcggcgcgcgcgacggcggcgagatggtgcagcgtctgacctacctcatgcggcacatctatgccacgtagtccaaccagactcggatcgtcaagacccctggtggcaagctcgtgtaccagtacaccaagaagagagccagcgggcccaagtgtcccgtgaccgggaagaagatccagggcattccccatctgatgccagctgagtacaaaaggtccaggttgtctaggaaccgcagaactgtgaaccgtccctatgggggagtactatctggaactgcagttagagaaaggatcatccgtgctttcctggttgaagagcagaagattgtcaaagaagtgttgaaat

SEQ ID NO: 78744 - DNA, 461 bp, Zea mays
  unsure at all n locations
  Clone ID: LIB3088-030-Q1-K1-F7
ccactcatacctcccactcttcctcttactcttgtttataatttaaaaaaaaaaaaaaaaaaanaaagttaatgttttttttaaaaaagaaaaaagccccccccaatcnnnntntatcttatttctttaatctatcttcaactttattttcttatttttattttttatattttttttttttttatttntacaactatttatattataatcatttttacctttttattctctttcattcattttatttcctattattcctttaaattataaatcaattttcttttttcatttaatcctattaccatatactctttaaacaatacttatacattctcctttataccttttcaatttttacatatctcttacttcatttccaattattttctattccaatttcaatcaatctatttatctattcatttttctaataacttactttatctttaactttatatatc

SEQ ID NO: 78745 - DNA, 339 bp, Zea mays
  Clone ID: LIB3088-030-Q1-K1-D1
gcgtccgctcctcttctcacgagcgcaacaccatgcacccaccatttcgaagcggatgctaccggcgacctgcttcagagatgtcaggcaggggcaatggcttcaaggggctcgggaagggctgcgcgaatcgtcaccggaaggtgctgcgcgacaacatccatgggatcacgaagcctgcgatccggatgctggcgaggaggggtggcgtgaagcgcatctccgggctgatctacgaggagacccgcggcgtgctcaagatctttctcgagaatgtcatccgcgacgctgtgacctacacggagcacgcccgtcgcaaaaccgtcaccgctatggacg

SEQ ID NO: 78746 - DNA, 334 bp, Zea mays
  unsure at all n locations
  Clone ID: LIB3088-030-Q1-K1-A2
cttcaactacnacaactttctcatagtttttttttatacgaatgcaagctccaacacattttcctttcattactttcaccccacataagctatcgatacattcaaacttatcttattttccattaaccctttcacccataatcactattacatcaaaaccgattgcttaacaaaattttcctccatatattgccccctccctcaaaaatatcatttctgcattccttaatatcctttccaacaatatatattgcttactttgtacaccaaccacatacacaattatttcccaaaacccttttttttttttttttcaattcccctacaaaaattt

SEQ ID NO: 78747 - DNA, 346 bp, Zea mays
  unsure at all n locations
  Clone ID: LIB3088-030-Q1-K1-A3
ccaatatccttaaagctgagaagtataagttgaagaaaatggcnaangcaaaatgcaatctttatctgatatatgtgaacaatccantnnttaactccgtcagtagagatggataacttcgtcgtgaatcaaacaagatgatggataacttcattgtgaatcaaacaagatagcctttatgagggaatgcaggttggaagtttggttcacaacgctactttacacatcacaagattattcacgattttttcaacctttttgttcgtttcaatattgtagaaaactactgtacttaatgtgaccacatatatgtttatctttaattgaaacccgatagtattttttt

SEQ ID NO: 78748 - DNA, 303 bp, Zea mays
  unsure at all n locations
  Clone ID: LIB3088-030-Q1-K1-A7
cggacgcgtgggtttaaacagcataataaatgtatctggaataagatgcgtgggcaccatgtagggcttgttcggttgcgtcggattgcacccggaatcgttccggctaatcaaagtttatataaattagagaagcaatccgaccgggaattgttccgacctaccaatccgacacaaccgaacaaggccttaccttagtgtgctccaattggtatcatttggcccatgctcacgctatccttttgcctctatgcccggactaatcangcgtgtgagaaatatncatgactctcccaattgctt

SEQ ID NO: 78749 - DNA, 292 bp, Zea mays
  unsure at all n locations
  Clone ID: LIB3088-030-Q1-K1-A9
tcgcccacgcgtccggcaagcgaaattctgccgatcccctctagtctccgcggcnaagatggggttgctcggcaagggcgggaagggcctttgcaagggcggagcgaagcgccaccggaaggtgctccgcgacaacatccaggggatcacgaagccggcgatccggctgctggcgcgcatgggcggcgtgaagcgcatctccgggctcatctacgaggagacccgcggcgtcctcaagatcttcctggagaacgtgatccgcgacgccgtcacctacaccgagcacgcgcgc

SEQ ID NO: 78750 - DNA, 433 bp, Zea mays
  unsure at all n locations
  Clone ID: LIB3088-030-Q1-K1-B1
ccacgcgtccggtagctgtcgagccggtctccgtttccggcgcgcgcctnnccctnctgcgacggcttcttcggctgggcgcaggtcggagcccctgctgttcctgtgcctgtactcggcgccccgcgggtgccacccggcctgcatggactgcgtcaagtccagccttagcgccgacccgcctgtgtaccagtgcatggaccgcgtcccctacttttttctgcgccgcttcaccgcgccttccgtctccgccgcgcggtgaccactctgccgacgcctaccccgcgactggtctcttgttgctctttgagtcttgacccaacccacccaccaccaaaccggtttcaattcttttttccaacccccacccgctggtgaattagtgtacttctaactttttaacccacctttagattaatggtttttttttttt

SEQ ID NO: 78751 - DNA, 150 bp, Zea mays
  unsure at all n locations
  Clone ID: LIB3088-030-Q1-K1-B11
cggttctagatcgcgatgcgcccccttnnttttgtttttttacttggggggttaccatacagcaatgctgctactgtatgaagggtggagtacacattcnaaagggggggggggggggataaagaaagaaagatatcggacgaccaatct

SEQ ID NO: 78752 - DNA, 183 bp, Zea mays
  unsure at all n locations
  Clone ID: LIB3088-030-Q1-K1-B2
ggagggggaatacacgaacgagcttgcttcttgtcatcttttttttcctgctgcaanttggttcctgtcttgttaagtatggggcatgagccttaggggttgattagtgaccagtcagatgacatccctgattctgcacctctgtttgcaattgcaataacagttgatatcgatcgtgcaact

SEQ ID NO: 78753 - DNA, 194 bp, Zea mays
  Clone ID: LIB3088-030-Q1-K1-B3
ctctagctctgcgtgcgggtttttctcttccctctacattatatcacctccatcctcaataattccatccatatccatatctactttttccatacaaacaacttatcttctctatccctatagcacaaagctctcatatctctacatccatttttctcttcatagtgatgcatcatcgcatctataacaatatc

SEQ ID NO: 78754 - DNA, 404 bp, Zea mays
  unsure at all n locations
  Clone ID: LIB3088-030-Q1-K1-B5
gcgagaggaagaggcgcgcgtgggtgcagtgcagacgtgcggggcagagcacaacagcgggggatccggggagggagggaagccatgggcgaggaggcggccaagaaggaggaggtggagaagcccaaggaggccgccgcggcagaggagaagaagaaggacgacaagcccaaggaagtaggcggcggcggcgagaagcccaaggacggggaggaggacgagaagaagaaggaggacgcgccgtcgccttcgccgcccccgccgccggaggaggtcgagatgcgggtctacatgcactgcgaagggtgcgcccgcaaggtcaagaagatcctcangcgcttcgacggagtggaggatgtgatcgccgactccaaggcgcacaaggtgctggtgaaggggaagaa

SEQ ID NO: 78755 - DNA, 381 bp, Zea mays
  Clone ID: LIB3088-030-Q1-K1-B7
ggggggggacgcacgcgttctcccacgcgtccgcggagtgtgatttcgctttacaatttgatcaacaataacatggtaaagaatgatcgtgagaggggtgaggattctaaaccagcctccattccaactgctgccggtggagggggagctaaatgagcttttgatcacttattgatggccaatatatgggaggaaacgtgattacatgcttaccacggttgtgctggaaccaaattgccttgaccttgaatggatattttcatgtttacttcacgtatgataaggtcaacggcaagaaaaatcatttacgttgtttgatagcattagatcatacctcaagttttctgtatattcttcgatgcttttttaatctgattcatt

SEQ ID NO: 78756 - DNA, 295 bp, Zea mays
  Clone ID: LIB3088-030-Q1-K1-B8
cccacgcgtccgcccacgcgtccgcccactcgtccgcccacgcgtccgcagctcgcgttgactacgtccctgggctttgtgcacaccgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccctttaaaaaaatcaaattttactacccggggttggcaaactaataatttttt

SEQ ID NO: 78757 - DNA, 372 bp, Zea mays
  Clone ID: LIB3088-030-Q1-K1-B9
ggcaaatcagagaaggctagcggccaaatcccaaagcatcaatcgtgcactctggttagcgctctgaagtctgaactgaatgtgtcatcccggaggacacattttgtaaaaaaaacagtagctttatagccttattagactgttaaaacacactcgactgaatgatgtccggttccatcaacaaggcttcacggagactgtcgagtacctgatctgggtcatgttttccatagtttgcttctgtgcagttgcctaataagcccattcgttgtaaactagctagttctaacttaagaaacctccctcagggcctatgcatgggtctctgattattgtgcagatgaactgttgttctggacattttgaacatgc

SEQ ID NO: 78758 - DNA, 317 bp, Zea mays
  unsure at all n locations
  Clone ID: LIB3088-030-Q1-K1-C1
gcggtttggtcgtcagaagaccttgcatggagttctgggtggtggaaaacctgctgatgtgcgtgttatggangaacggaaagagatcatcnaatgttctggctcttgcaacagctatttgggttttctttgagtggctcgactaccacttactgacaattgtttcatttgcccttgttcttggaatggttgtccagtttgtttggtccaacttctcaaacatgctaagcagcggatcccgttctcaggtgccccgagttgaattgcctgatgagttatttgtgaacattgccgttgcaatcggtgcccaaataaac

SEQ ID NO: 78759 - DNA, 302 bp, Zea mays
  unsure at all n locations
  Clone ID: LIB3088-030-Q1-K1-C10
ttcctactcaaccacaccctctntagtatatgttttacgaccaaatgatctntcacagtcanctgccaaaagaaaaaagcgccccacaccaacaaaatctaccacaacaaccaaactaaaaacaaaaaaaaaaatcaaaaactaaaaacaaaccaaaacaataccttactataattacaatcaacaaaacaaaaaaaaaaaacattatatagctcccctctctttaaaaaccccatttcactccccactcttttaatccttttaactttcttttaactttacataaatctatttaaacctcc

SEQ ID NO: 78760 - DNA, 384 bp, Zea mays
  Clone ID: LIB3088-030-Q1-K1-C3
gcgcccactcgtccgcccacgcgtccgtccatggccaatgaattggccggcaccgtcaaggagatcctcggtacctgcgtcagcgtcgggtgcaccttctactgcaaggaccccaaggacctgcagcaggagattgacgacggcgaggtggagatcccgtccgcttaagaaggattggtgtccaggactgtgttatctttgctgctgaagccattttctctgcctagattttctcatatttatttgaggtgggggtggacgtggacgtggaactatggaagttatcacagcggagttttgcttagaaacttgtcatgctttagtctgagacaatttatgaacattcctaggtacaatccaagttaccaggcctgggtttgttgg

SEQ ID NO: 78761 - DNA, 329 bp, Zea mays
  Clone ID: LIB3088-030-Q1-K1-C4
acggtaacattcttgatcgataactaacatgttatgagtggagggtatattcttatcacaccgaacatgtgcatgtagcccctgtttccttctatctcgtgttctttcatgtaaccatcacaatatatatacatgttgcttaaataaacaaaaaataaaacaaggaatgtactattattatataaaataaaaccaatttaaacgctgtaaaaaaaaaaaataaaaaaaaaaaaagggctgccgaatcaaaaagatccaaacttgcgctcgccttcttaaaaaccccatatttcctccctcgtgcctccaaaattaaattcattttttcg

SEQ ID NO: 78762 - DNA, 423 bp, Zea mays
  unsure at all n locations
  Clone ID: LIB3088-030-Q1-K1-C6
ggtgctcctcggcttccacctgggggtttggctgctctaaatcctaagttgaccattgtgaggaagcactctgctgtggcaaataatanttcaaatgcaactggagcgacagagtctgcagatgatgatttgcctagtgtcatgacttgcgccaactatcttaaactaccaccatactccaccaaggctatcatgctaaagaaactgctttatgcgatcaacgaaggccaagggtcatttgatctttcgtgaatctcaacactaacataggtattggtccacctagaaatctgcgtcattgttacccagagttagtttctacctcattcatgtatgacataggttaaactcagctctccggagtcccaccgaaggtttggagcccgtacctttgggtgtggatgtctatactctcttttcttg

SEQ ID NO: 78763 - DNA, 380 bp, Zea mays
  unsure at all n locations
  Clone ID: LIB3088-030-Q1-K1-C8
tcccactcgtccggccaaccgcttcatgtcatttgtaaacgctggaacctctccgtggacgaaatactggctttggggcaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatnggggcgcccttttaaaaaaaaaaaatttatattccccttcaattaaaaattaaaaatttttttttagtgcaacaaaaaaaaaataaactgccccctttttaaaaacctttaaactaaaaaaaccccgctttaaccaaattaaataccttttaaaaaaaaacccctttt

SEQ ID NO: 78764 - DNA, 237 bp, Zea mays
  unsure at all n locations
  Clone ID: LIB3088-030-Q1-K1-A10
gggactagggaatgcacattgttagtttaaactggacatttctgtgtgctcctctgcgagtccttgtcgtcgtgtaggtttgagttgagctgtcangttggagtgacccttctcctgtgtaacgcttgcctggtactgcttcagttatttggacactgtttgtgttgagttgttaacttcaagggtgcaaacctggataattatttagttattatatgactatctggtatccggttt

SEQ ID NO: 78765 - DNA, 397 bp, Zea mays
  Clone ID: LIB3088-029-Q1-K1-G10
cccacgcgttcggcggcaagggtctgggcaagggcggcgccaagcgccaccgggaggtggggcgtgacaacatggagggcatcaccaagccggcgatcctcacgttggcgatgaggggcagcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcggtggcggtcgtgttgtgttcttggtctagttagtctgtgttgtccttatcggtgct

SEQ ID NO: 78766 - DNA, 389 bp, Zea mays
  Clone ID: LIB3088-029-Q1-K1-G11
ccacgcatgcgtccctcactctcgtcgccggttggaggaataagacgaccaagcgcactgcccgggaatctggcgatgtctacctcgagctcggtagtaagctctaccgtttctcgcaacatgatgaccaagagcaatatacaacgctgtcattctcaataggcgtactatggagtaaaaccaatccaccaccaatctacatgctccgatcttgtcaagtatatggaaagaaaagagaagaacatttctagcattgtctgacaaacacacatgacaacaggatccatgacagttcagcaatgaacgttactgtcctgaggttcactgagacagaaagggccatgattgacaattctgcgagctagtgcctcacatttgaccagatttgt

SEQ ID NO: 78767 - DNA, 191 bp, Zea mays
  Clone ID: LIB3088-029-Q1-K1-G12
gcggccgagacttacaagatctacatcttgaatgatctgttgcatgacctcgtaatgtattgtgagaggtgcgtttggtgatggcgcaatcccaaggggaccctaacttcagagatgtaaagtagttttgggagctgcagtacaaatttaattttcgaattttggaaaaataaactaccgagagatccata

SEQ ID NO: 78768 - DNA, 376 bp, Zea mays
  Clone ID: LIB3088-029-Q1-K1-G2
cgaccgcacgcgttcgctgaagctgatgttgggcacgcctaacgccccaaagcctgaagaggatgagtctgctaggctaacgcaagcttaccaccgggggctgctccctagggctgtcatatctcaacatcaaagcggtgaccagcctcagccactcctgatggagggccaacagcagcatgctgcaccagcatctgactacttcaacacttcagcaccaccagcagcggatcggactgtgtatccatcaatggatccacagacgatgggtgctatagtttaaccccatgacagtgaatgcaaaccagtgccctaacaagcttggcaaggtcaggcattaagcaacccagcacatgggggccgtttattctgcatt

SEQ ID NO: 78769 - DNA, 308 bp, Zea mays
  Clone ID: LIB3088-029-Q1-K1-G3
gttcgcgttagtgtcggcagagacgaagacgggagcggcagttcaggtgaatcaagccggaaggaaagcgccgaagacgaacacaagagtggcctctcccacccgacgctggatgggctcccggttagtcggttacgcaacgcggtgagatcacttgggtccgttttgagaccgcagaggagacagttaccagtatagcacatttcctttaaccgcccatgtaaattcaaggtcgacagaccacacacacagatcattgatagcgcgtacagggagaggaaggtacacagacagaaatggaagagagt

SEQ ID NO: 78770 - DNA, 55 bp, Zea mays
  Clone ID: LIB3088-029-Q1-K1-G4
aaaaaaaaaacactaattaataaaaaaaataaaaaaaaaaaaaaaaattataaaa

SEQ ID NO: 78771 - DNA, 67 bp, Zea mays
  Clone ID: LIB3088-029-Q1-K1-G5
cggacgcagtggagtgggcgggcgtgcccacacgctatcttaaatttatctgggaccaagggaccat

SEQ ID NO: 78772 - DNA, 232 bp, Zea mays
  Clone ID: LIB3088-029-Q1-K1-G6
ggaccggtccggaagacccacgccgaccgcacgcgatcgttaaaactgatgatgggctagcctcatgccctaaagcctgaaatggatgaggggctctggcaatagcaggaggcctacggagggctgcttcctaaggctagttatatctaaacagcagagcgtgtaccatccttaatcccccgggatggagggccaacagcaacaagatgcaccatcatcttacttctttaac

SEQ ID NO: 78773 - DNA, 242 bp, Zea mays
  Clone ID: LIB3088-029-Q1-K1-G7
tcggcgcgtcgtcggcgaccccttcagggacggggtcgaacaggggcctcagatggacggcgggcaattcaacaagatcttgcggtacgttcagtccggcgtcgacagcggtgccaccctcgtcgccggcggctacagggtaggcgacaggggcttctacatacagccgacagtgtttgccgacgccaaggacgaaatgaagatcgctcgggaggagatattcgggccggtgcaaaccattc

SEQ ID NO: 78774 - DNA, 379 bp, Zea mays
  Clone ID: LIB3088-029-Q1-K1-G8
acccgactatattgggtttcaccgaggagagggttcgaagaaacatggaattcttgatgagggttgtcggattggaggtaccatacatcgcacgaaggccagcgctgataaattatagtattgaccgtcggttgttgccacggaattgcttgatcaattttctcagggcaaaggggttgttcaatgacgaggctagtttcctttctgtcgccgctataggcgatgagaaatttcggcgccgatacgtgcatccttacgaggaggattttccaggccttgctgctgcttttgcttctagctgtgctggagaacaccaatgggaacgggtttattaggatgacaggcgaaaaataaagaaagctgacaattggtctggaaa

SEQ ID NO: 78775 - DNA, 304 bp, Zea mays
  Clone ID: LIB3088-029-Q1-K1-H11
atgcgttcgatcatacgtacgatctagactgcctcatcgggctcgccggtggtgacaggatgatgtctgcgaccgatggcaggaagggcaaggacatcactgacgcggctaacagaagcagcagaatcacggagcacactgcttctaacaagaacatgcatgtctggataccccacatcgattctgcgattccacaacgcctaccacatagttagatacgcgtaccaggacacaaacaagccatgtaagacatctgacacagtaaacgcttgtaatcagtcagggaaaaaacatgcaagccgtg

SEQ ID NO: 78776 - DNA, 125 bp, Zea mays
  Clone ID: LIB3088-029-Q1-K1-H12
caccatccgccaggtgtctatgatcctactagacatgctcagcattattcgtggactacggagtcctacatgcagggcatggacattattagatagtgcagattcatgtacatcttgaacatcta

SEQ ID NO: 78777 - DNA, 237 bp, Zea mays
  Clone ID: LIB3088-029-Q1-K1-H2
gacgcacgacgtccggcgggcagatgctagacattacgactgctgctggtgagaagaacctatacgacacatggggcatgcgatacaacatattggcatcttgattaaattacatccggaagagcattcttggacagatcactcaacgtcagtaagtaagctatatctatttggttgcatggctcactgccttgctaatttcgctacatgtaatgcaacgttcacatttgtactctg

SEQ ID NO: 78778 - DNA, 307 bp, Zea mays
  Clone ID: LIB3088-029-Q1-K1-H3
gctctacccgcatcaccccgccgttgccggccccttcctcccgcttcccacctcgccggggccacctgttcctcttcctcagcgccggcgcttgcgcgccccttctccaccccgttgaccgccgcacccacggcctcgccgttgcagcactcgtgcgatccggtcacgagtggagcgcacgagctcattcgcttgcttccggcttcccctctttcttgccggagcccgcgccttctcttcttgcctgcgccttcgtctgctactgcgcccctttcttcacgtcgcacccacggtctcgtgttgctgc

SEQ ID NO: 78779 - DNA, 375 bp, Zea mays
  Clone ID: LIB3088-029-Q1-K1-H4
agaaggtggaggccaagaactcgctggagaactactcctacaacatgcgcaacacgatcgagaggacgagaagattgcgtccaagctgccggccgatgacaagaagaagatcgaggacgccatcgacgcggccatcagctggctggacgccaaccagctcgccgaggcggacgagttcgaggacaagatgaaggagctggagagcctctgcaaccccatcatcgccaagatgtaccagggcgcgggtgaagacatgggcggctctggcggcatggacgaggacgcccccgctggctgcggctgccctggccccaagatcgaggaggtggactaagcggtttggtgtcaggtcttgagcgtgctgcagttgcttgg

SEQ ID NO: 78780 - DNA, 441 bp, Zea mays
  Clone ID: LIB3088-029-Q1-K1-H5
aaaatagatccactattccatgtgccacatcaagtaaaatgtctgattagacgtgttacggagaagtcatcttgggcttgttacaggaaaagaaatgcatgctacacttgcatttcaataatacccggattcaataaaaaatattagtgttaataacaatttacatctacaagttttaagcctacacaggttatgaactgaggaagccaacaatcttccattatggatctgaactctgagttattacactagatttccaaaaaaaaatactggatgtgaactgcatctctatggaatgcgaacgaaatgctgctgcaccaatcatttttcttttcatgaagcttcggtaaacaccggtattataaaatttgcaatggtgacactatttgaatggccttctgacaataaagaatggtttggcttaaatttgaccaacactga

SEQ ID NO: 78781 - DNA, 221 bp, Zea mays
  Clone ID: LIB3088-029-Q1-K1-H7
tgccacacgttctctcccaacttacctccatagactcctgcactaaataaagggctattgggaacattttacattacacatgacatcagctcacatcactgtatcacgcaactcaacttgcctgcctactagaaataacttcttctcttgcttactactcctagcactcttcctactcttctacattctcttctacctattatacaatctaatcatacact

SEQ ID NO: 78782 - DNA, 249 bp, Zea mays
  Clone ID: LIB3088-029-Q1-K1-G1
cctttgctagaatgacttgctcccaaaaaagtcacctatgattgttgttaaatgccaaaatcatcttaatcttgtagtggggaataatgttcctctatttttcaatatacgtgatggttcttacatgccaaccctgcgtctttttcatcagtattctgatatcatgaaaaaatttcaagtggatagaggttctatcaaaatttgtctatctggcccaaacataatgtgtcctgggttgactttaccttg

SEQ ID NO: 78783 - DNA, 399 bp, Zea mays
  Clone ID: LIB3088-029-Q1-K1-H8
gtttcgtgggtccagcccagagtgcttggaatcccacaggttaaggctttgcgcgaccggctggatgcctgggttggaaaggtgcatactacattgctttcagttgaggcagaaacacctgatcttgttgctgcctaatttagcacctgttacacttccgcgagaggcttggtcagcaaggtgatgagatgcattgtgacacttgtagtcattttctggataatgaacctgctgccctgagcgtttgtcagcctgcgttctgatcggggcctgtaatttcttttttgatgtcctctggacatggatgggtacaactttacgcagtgtaacggaaacgggaccaaatgattgaaatttttatactagtaaggtgttactgtagttttcccagttggattt

SEQ ID NO: 78784 - DNA, 342 bp, Zea mays
  Clone ID: LIB3088-029-Q1-K1-H9
tgtagtcgttccaacatcaatcaatttgttattactgctcgtaattcttcctcgcatacgggatacttcaataaggaccaatggactaccacatcatattcatttatgcacatttagaatatcatctaaactaacctctttcacttatcagattccaactttgctctcccactctgatgctccatcttcactatcatgaactaactcatattccttcactgtcgaacacattccatcttcttgccacataaatcctagtagatcgcttactatatctactgatcaagcatcatcctttttccaatcggcctaataactatcaatacttcatataaaacttta

SEQ ID NO: 78785 - DNA, 262 bp, Zea mays
  Clone ID: LIB3088-030-Q1-K1-A1
gcgcccacgcgtccggtcaagcttgaggagcagagggttgagtgcattgctcagctagaagagaacaatgtgttgagaagtaaactcaaagacattgctgatcagtataacattactcagcagaaatatgctcaccaattgaaagagaaaatgatggaacttgagcttgctgatctgagacttcaacaacatcaagagaaggctgctcacgaacatacccaaatgcaattgtatgccgagcaagttctcagctatgactact

SEQ ID NO: 78786 - DNA, 182 bp, Zea mays
  Clone ID: LIB3088-001-Q1-K1-C6
tcgagcaggagacaggctgggtagtggaatctaatgctaccaggatcggatcaacggcttgtgcgcttcaattggcggccgccgcattaaggttgtggtgaccggccccaaggggtacctgggaaggcggctgtgccccgcgcttgccggcgcgggccacgccgtgcgcccgcttgttcggc

SEQ ID NO: 78787 - DNA, 235 bp, Zea mays
  Clone ID: LIB3088-001-Q1-K1-C7
gttctgagaccggcgacgaggaaagatgatgacgacaacaaacgttgcgctgccaggtcgtcaccgcgttcgctgccaagaataataacccgctgccaccctagaggccgcgactactattacgccctttgcttgcattgcatcccgtgttagacttgtgctcatgcgcttcactgcatcctgttgtatctggatggatttgaccaaatgcaaattgccaacatttttattattt

SEQ ID NO: 78788 - DNA, 53 bp, Zea mays
  Clone ID: LIB3088-001-Q1-K1-C8
ctggaacgatcatatacacaatcgagttaaataagttgtgatttgtacttgac

SEQ ID NO: 78789 - DNA, 330 bp, Zea mays
  Clone ID: LIB3088-001-Q1-K1-C9
cccacgcgtccgaccagcggcaccacccatggcttcggcggcggcgagatccggtctccggtcgctggcggtgcgcgccgccccgttgaggcgccgcatgtcctcctccgtccacgacgacgcctatgagacggccaagtgggagaagatcacctacgccgggatcgtgacctgcaccctcctggcggcgtacaacctgtccaagggccacccccacttcgatgagccgccggcgtacccctatcttcacatccgcaacaaggagttcccatggggccctgatggcttggttgagacgaaggaccaccactgagccctgattagcacacc

SEQ ID NO: 78790 - DNA, 331 bp, Zea mays
  Clone ID: LIB3088-001-Q1-K1-D1
caaatacttggcctccgtcagagaggggagaaagacccgttcgaggcggcggcgatgtcgtggcgcggcaagggcggcaagggtctaggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatacgcgacgccgtcacctacaccgagcacgcgcgccgcaagaccgtcaccgtcatggatgtcgtctacgcgctcaagc

SEQ ID NO: 78791 - DNA, 362 bp, Zea mays
  Clone ID: LIB3088-001-Q1-K1-D11
ctggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgtagacctcactgtcagaatcgagaagggggcctcctacgaggaaatcaagaaagctattaaggccgcttctgagggcccactcaagggtatcatgggctacgtgcaggaagatctggtttccaccgacttcaccggtgacagcaagtcgagcatcttcgacgccaaagccgggaatgccctgaaacgccacttcatcaagctcgtctcgtggtacgaca

SEQ ID NO: 78792 - DNA, 383 bp, Zea mays
  unsure at all n locations
  Clone ID: LIB3088-001-Q1-K1-D12
cccacgcgtccgggcggcggcgatgtcggggcgcggcaagggcggcaagggtctaggcaagggtggagccaagcgccaccggaaggtgctccgcgacaacatccagggcatcaccaagccggcgatccggaggctggctcggaggggcggcgtgaagcgcatctcggggctcatctacgaggagacccgcggcgtgctcaagatcttcctcgagaacgtcatacgcgacgccgtcacctacaccgagcacgcgcgccgcaagaccgtcaccgccatggatgtcgtctacgcgctcaagcgccagggccgcaccctctacggcttcggaggctaggcgcctcttcgtagctggggaatgcttanggtgatacgtctctgtcgct

SEQ ID NO: 78793 - DNA, 307 bp, Zea mays
  Clone ID: LIB3088-001-Q1-K1-D2
cccacgcgtccgaaattggcgtgacaagcggcgtgcagagattgggcaggggagcctggattcggttactgggaacagctagggggcaattaagcgaacagaaacgtgacatccacccatgcatttcgtttgtttatttccaggtccattttcgttctggcggcggtcggcaggccccagggttgtacatttctaggtcagggaagagtgggaaagcggcagcgttgtactggacagtgaatgcatgtggttgtacatgtaaattctcagaaaagttttgtgagaatgaaaggacatatttgagttc

SEQ ID NO: 78794 - DNA, 290 bp, Zea mays
  Clone ID: LIB3088-001-Q1-K1-D4
cccacgcgtccgcggacgcttggacgcacatgccatacacgctgcagctactcaactgaaatgagcatcgtatcgcagctatcgtgaataaaacctgaatcacccacaacaatgttctaagtactcagccagtggtatttactggttgacctactgcagtctgcgtcggaatagatatgtggatttactcttcgtggggcagtattgtactggtggattcataaggactctgattatggtgcgttcggaacttataataataagcacatgaaattgtgcttcaaaataaa

SEQ ID NO: 78795 - DNA, 408 bp, Zea mays
  unsure at all n locations
  Clone ID: LIB3088-001-Q1-K1-D5
gttccattcgtccgttcggcgcgctcgcaccagatccgtccacgtttcatccagatctgtctgacctgccttttctccccccgcagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcggccgtggaggcggcggtggcggatacggtggcgggcgccgtgatggaggcggctacggcggtggcggtggaggctacggcggtggtcgtggaggctacngcggcggtggtggatactgtggtgcaaaccgcggcggctgctactgcaacaacgacgggaactggaagaact

SEQ ID NO: 78796 - DNA, 255 bp, Zea mays
  Clone ID: LIB3088-001-Q1-K1-D6
aaggtaccgcaactgtcgggtctcaggctccacgagactgcagcatgcgttcagaggacgcaccctgacggatcgttcacctacgttgacgtctacatcggcacatacaaactcatcagcgcatgccaataagctaggttttgactaccctatgctgtcatgcttaggctactgcggcagccggtacaccttacacctgagcgtaggatgctgcggtacgaagcaggttaactctacgtcggtggtggtggggaa

SEQ ID NO: 78797 - DNA, 305 bp, Zea mays
  Clone ID: LIB3088-001-Q1-K1-D7
ctgggacccgaagggcaaggttggcccgatcactcctcttccggacctggtgaccatccacaccccgaaggacgaggacgagccgcgccctccggtcttggcacctcctgaggtgtaaggtcccaactgtgtccttgaaatggcagtttgatcgggtcctagataggtttctatcttacgataaggacaatgctaaggcagttggttaccttaatctttatggacagatgctatgtgttgcttctgtggcacttttgtttaagctaagttttgcggagacaagatacttatatatgttcccgatg

SEQ ID NO: 78798 - DNA, 274 bp, Zea mays
  Clone ID: LIB3088-001-Q1-K1-D8
cccacgcgtccgcccacgcgtccgcccacgcgtccgcccatttcaaatccttcgatcgcacagcgccgcccgccctcacgcagctctctccgatggcgcgcacgaagcagacggcgaggaagtcgaccggcggcaaggcgccgcggaagcagctggccaccaaggcggcgcgaaagtcggccccggccaccggcggcgtgaagaagccgcacaggtttcgccccggcaccgtcgcgctccgcgagatccgcaagtaccagaagagcacggagct

SEQ ID NO: 78799 - DNA, 281 bp, Zea mays
  Clone ID: LIB3088-001-Q1-K1-D9
cccacgcgtccgcccacgcgtccgtggatggtaagtactttataataaaaaaaaaaggagaaaaaaaaaaaaaaaagaaaaaaaaaaaaaaaaagaaaagaaaaaaaaaaaaaaaaaaaaaaggtcctttggtctatcggtttctagcttacgtgctcttgcatgcaatatcttaacttttttatattgtcacctaatttcaattaactggccgacagttcacaatttcgggcctgggaataccttggcgtttcgaaatttactttgtttgcatcatattc

SEQ ID NO: 78800 - DNA, 270 bp, Zea mays
  Clone ID: LIB3088-001-Q1-K1-E1
ctcacgcgtgcgctgacgcgttggaactcgaagggttactatgcctaggaggctgcccgtttgaccgcccacgccatcatgatgaacaagtctgggcagattgtcaacgcctatgcctgagcgctagactgcgatacctccaacatcgtctgcaaggttgctgagctcattaccaacatcgacaggcgatctgtcacggagctcgcgaaggagtctaagtttctgaagaacggatatgctggtatggtgaagatgatttacaccaagcct

SEQ ID NO: 78801 - DNA, 429 bp, Zea mays
  Clone ID: LIB3088-001-Q1-K1-C5
ggagtcgtgggcgacctagaaagaggccattggaaactgaaactgcagaaacccaagttgctgcatcggtggagaagcgagggcgtgggaggccaagaaagaagaatccatcggcagggtggtctgcaggaaccagggatactgcattaaaggggattaagagagggcctgggaggccaaggaaggccaggccttttgaaactgagtctgtgaaaactgcacttgaggtgtctagggacttgacagaagatgggcctcaaaaggatggggatcttgtgtcagggaagaaagcagatactcatggtgtggtttggtagtgtcaactgaggaggtagccattgctcccatggatgctgggtgcgcagacgccaagggttgatctgatggatgtgggcaccaagagtcactagtgctctgatggtgcgaaca

SEQ ID NO: 78802 - DNA, 388 bp, Zea mays
  Clone ID: LIB3088-001-Q1-K1-E10
attttatatgttctcagttttcatgtatatccctcccttcatttccaatgaaatattggcttctaatataatccgatggagttcactatcggctttagcttttgtgttccgtaatcttgttaacaagaatgcttctgcaattactgtcaaatcaccactggatgttcttaattctgtgtgaacttctttaatcttatagatggacctcaaaatgattctgaacccaactatttgaatgtggtcatgcagtgagatagaaaagttgaaactttcagagcttacgtgccgggaaggcattgttgaagttgcaaagataatttatggagtgcatgacgaagcgaaaggataaagcttcgagttggagttgagctggatctgcgatgaatcg

SEQ ID NO: 78803 - DNA, 351 bp, Zea mays
  Clone ID: LIB3088-001-Q1-K1-E11
ctggagaggtggcagggctgccagctttaacatcattcccagcagcaccggtgctgccaaggctgtcggtaaggttcttcctgaattgaatggcaagctcactggcatgtccttccgggttcccaccgtggatgtgtcagttgtagacctcactgtcagaatcgagaagggggcctcctacgaggaaatcaagaaagctattaaggccgcttctgagggcccactcaagggtatcatgggctacgtggaggaggatctggtttccaccgacttcaccggtgacagcaagtcgagcatcttcgacgccaaggccgggattgccctgaacgaccactttatcaagctcgtctc

SEQ ID NO: 78804 - DNA, 177 bp, Zea mays
  Clone ID: LIB3088-001-Q1-K1-E12
cccacgcgtccggaacaagggcggtgctacaactactgcgttgtgttggatgtaaagccttgatatattatcactttcccatgtagttgtggctataggcggcttcttttcagtgaacatattgtctgtttcagcgttcttgctggatggatagtaaatggctgtaccatttggttg

SEQ ID NO: 78805 - DNA, 401 bp, Zea mays
  unsure at all n locations
  Clone ID: LIB3088-001-Q1-K1-E2
ctcaagcgtgggttcgtggcctccaactccaaggatgaccctgccaaggaggctgccagcttcacctcccaggtcatcatcatgaaccaccctgggcagattggcaacggctatgccccagtgctggactgccacacctcccacatcgccgtcaagtttgctgagctcattaccaagatcgacaggcgatctggcaaggagctcgagaaggagcccaagttcctgaagaacggtgatgctggtatggtgaagatgattcccaccaagcctatggtggtggagacattctccgcgtatcctnccctggggtaggttgccgtccgcgacatgaggcaaacggttgctgttggagtcatcaagagtgtggagaagaaggacccaaccggcgccaaggtgaccaa

SEQ ID NO: 78806 - DNA, 324 bp, Zea mays
  Clone ID: LIB3088-001-Q1-K1-E3
actcctccgaacccatctacgataccatctacaactctagcattaaatgtgacgtttattggggggagtacctgtacggggacattgactctaaattatgtacgaccatgttccctgtcatctctaacattatgagcatagatattactgtccttgctcctagcagcttgaatatcaatgtctatgcgccttctgaaataaaatacattctttgaattgtttactctatccttgtatcgctcatatcgttccattaaatgttaatattcaaggattgattactaatgattctgttccttttatattccacctaaaatgcttttt

SEQ ID NO: 78807 - DNA, 169 bp, Zea mays
  Clone ID: LIB3088-001-Q1-K1-A7
cccacgcgtccgccgtcgtgctccccgacgacgcgcccatgcgcaagtacatccgcttctaccgcgacttcgtgctcgccctcaacagcgcgctcgccgccgacgaccgcgtcgagatctgccagctccccgtcggcgacggcgtcacgctctgccgccgcgtcaagtg

SEQ ID NO: 78808 - DNA, 377 bp, Zea mays
  unsure at all n locations
  Clone ID: LIB3088-001-Q1-K1-A8
atagacctcaaggagcagaaggtgacagtcaaaggcaatgtcaagcctgaggacgtcttccagacggtttccaagtcggggaagaggacctcctactgggagggcgaagccacggccccggacgctgcggcggctccagaagccgaagcagctcccggcaccgcggcagaagcgcctgctgctgctgctccggcggcgccagagatcaccccagccaaagctgacgcctgatcgtcacgctattattcactcacatgtgatgctgcggctgcgactcctaaaccttaaatctagaaatagctggggattgggtttgcattgcatcgtgttcttgccggtctagcaagtgactantagaataatggaataaacgatga

SEQ ID NO: 78809 - DNA, 229 bp, Zea mays
  Clone ID: LIB3088-001-Q1-K1-A9
cccacgcgtccgacgtttgctagtgactctagcctgccaggcagttcttaacttcactgctctgcctgtgcatgttattattcctcaaatgtgtcgtctttatcagtacattgccccatcacaggcacagacatactgttagatgtatgagcaattgtcggcttgtaatttattggtagagctatgctccccctaacatttatatgtatatatgtgctcatgattcttg

SEQ ID NO: 78810 - DNA, 105 bp, Zea mays
  Clone ID: LIB3088-001-Q1-K1-B1
cccacgcgtccgagcttccagttgcctgtacacttcattaaatcgagcactagcaacggagatagctagatagaggaagactaatattactagttagcactagat

SEQ ID NO: 78811 - DNA, 261 bp, Zea mays
  Clone ID: LIB3088-001-Q1-K1-B10
cccacgcgtccgggacaaaggagcgagtgatgattattcaatccaacagcgactaggtcacttgtaatcaatccatggtaacacatcgtagcacaagagagagcgccagtcttgcaggagagacatccattctcctgcttaaactccacaaacagatagtagcctaacccagacagaatttctgaagcctaaaagatccccccaataccgacgaaaccactgcattccaatcagttgattgcattagccaagcacaagcgc

SEQ ID NO: 78812 - DNA, 291 bp, Zea mays
  Clone ID: LIB3088-001-Q1-K1-B12
catatttataatatcgtagacatgtgttctaaaaaaaaaaaaaaaaaaaaaaaaaaagagaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaaaaaaaaaaaaagggggggccgttttacagggacccaggttttgttcccctggtttgcaacgtaaagattttttttaggggccccctaatttaaataaagggggggtgttttaaaaaaggtttgccgggaaa

SEQ ID NO: 78813 - DNA, 434 bp, Zea mays
  unsure at all n locations
  Clone ID: LIB3088-001-Q1-K1-B2
cccacgcgtccgggatgagtaccagcttgaagatcttgaaatcgtttctgctgattatatgttgaaagtgggagtatctaacttccgaaatgcctgggaaaacatggatccagagactgagcgagttgacgagtatgggcttggaataagggagagcttggctgaagctgtaagtgctgttataagcatncttggcatgcagccttgtgagggaactgacgtggtcccaaagcaattcaggtcgcacacttgtctgctctctggtgtggttattggcaacgtgaaagtcttggtgagactgtcattttgaaatagtgcaccgaaagaggtggccatgaaagctgcagttagatctgatgatccagagatcagtgacaggatccacgaaattgtcgctaatggctaaaaacaatggtagtatctttttttttact

SEQ ID NO: 78814 - DNA, 393 bp, Zea mays
  Clone ID: LIB3088-001-Q1-K1-B3
gtgatcaaaggatgggatcagggtctcctgggaatgtgcgttggtgaaaagcggaagttgaagatcccatcaaagcttggctatgggcctcaaggctcgccacctactattcctggtggagcaaccctcatatttgacacggagcttgtcgctgtcaatggagaaccaaccaaccaatctgacgagctttagattcatcaaacaaatgaatccattcacctttttactcggaactcagcagatgtaatactttccaagaaatgagccttcattccctgccactttcatagtttctttcgctgttccacactgacatctatgatttttggagcaaactctgatcttgtttgactagtttacacgtttgtgtgtggaatctgaagagctggtctg

SEQ ID NO: 78815 - DNA, 420 bp, Zea mays
  Clone ID: LIB3088-001-Q1-K1-B5
cccacgcgtccgcccacgcgtccgcggacgcgtgggacaagatcatggacttcatcaagtttgacgtcggcaacgtggtcatggtgactggtgggaggaacaccgggcgtgtaggagtcatcaagaacagggagaagcacaagggcagctttgagaccatccatgtgctgcttggagctttttgctatgtctagttttctcctatttgttgtacaggaaaacatagaatagaattcaaatttggtggtcgcaaaagtgtggagactttaattcatataaagttaggcttaacattagtgcaaacagttgtattttagtttagatttagagtacacttatgtatgcattgtttgacaatgtttatttatgatatattgaatggtacttatttatattatattaattataatgttggtcaat

SEQ ID NO: 78816 - DNA, 351 bp, Zea mays
  Clone ID: LIB3088-001-Q1-K1-B6
cgaagttcaacctaaggcagctgacctcaccggagtcggagaagtaagcctatgagtgacaaaatcttccaggcaaaacgtggaccaacttaaatcagcagcagcgtcaggtggttaggcgctagcgaattaaattaaggccggtcgaacctcactgtcttgaaagattcagatgttctaatgtctaatgctttaccaccagtggttagtggttgctggttcatgcttcccaggttagagtcacgattttttttttttgaggctgtagaaagatctgacgatacttcatgtgtgctttctctctgacgatggttccatacaggggcttaccaaagacgtagaatctatcgt

SEQ ID NO: 78817 - DNA, 406 bp, Zea mays
  Clone ID: LIB3088-001-Q1-K1-B7
cttaggagctggaatggtaaactcttaattttcaaccggctagttttcttgagcctacagatgcatgctacaagacaaatttttcatcagatttgcaccataatacttgtaatattttagatagcttgaagagatcataccttttgtttttattgtctttctacattcagacatctaggagctttacgaaggaagagatctctaaacataacacaaggaaggactgttggatcgtcatcaaggacaaggtctatgatgtcactccttatgtagaggagcatccaggcggagatgccattctaaataatgctggtggtgattccacagagggcttttttgggtctgtaacttatattgcttcctatacctcataacatgctctgtcattgcctgattagttcagcac

SEQ ID NO: 78818 - DNA, 100 bp, Zea mays
  Clone ID: LIB3088-001-Q1-K1-B8
cccacgcgtccgcccacgcgtccgcggacgcgtgggaaaaaaaaaaaaaaaaagagagagaaaaaaaaaaaaaaaaggaaaaaaaatataaaaatataaa

SEQ ID NO: 78819 - DNA, 102 bp, Zea mays
  Clone ID: LIB3088-001-Q1-K1-B9
cggacgcgtgggaaaaaaaaaaaaaaaaaaaaaaaaaaaaaaaaaaaaaaaaaaaaagaaaaaaaaaaaagggggggcctctataggggccccatttttata

SEQ ID NO: 78820 - DNA, 143 bp, Zea mays
  Clone ID: LIB3088-001-Q1-K1-C1
aaaaaacataaacatataaaaaaaaaaaagaaaaaaacaaaaaaaaagcaaaaataggggggactacactactggggcggcctgggtcttaacttgagctttcaccaagctcccctcgcttggttctctttgccctcattttt

SEQ ID NO: 78821 - DNA, 327 bp, Zea mays
  Clone ID: LIB3088-001-Q1-K1-C10
cggacgcgtgggcggacgcgtgggcggacgcgtgggcggacgcgtgggcggacgcgtgggcgagtccaagcattcaccggaggatcccaaatcacactctccagtaaccgtccgcttctccagccgcatctctagccgagtctatctcctcctcctccgccgccgccgcaactatcctaatggctcgcttcgccgtggtcgccgccatcgtcgccctcctcgccgtcgtcgcggcggcgcaggccccgaccacagctcccaaggccgcgcccaggatggccccgctgccgcctccccctgcgcggtccccggccacagccccggcgc

SEQ ID NO: 78822 - DNA, 368 bp, Zea mays
  Clone ID: LIB3088-001-Q1-K1-A6
cggacgcgtgggcggacgcgtgggatcgggaacgagacgttcgagaagctggggacgctaggcacgtcggcgaacctgctggtgtacctgacgcaggtgttccacatgcggagcgtggacgcggcgacgctactcaacgggctcaacggcaccaccagcctcgcccccatcatcggcgccttcctctccgacgcctacctcggccgctacctcgcgctcgccatcgcctccgtcgcctccctcatcgtaagcgcagcgatccatcttcagtccacccctctcgctcgttacctgcttaatttgagggacaccggggtcggaatcagttcgggggtagatggaatggaattcggcattgctgtgcttgc

SEQ ID NO: 78823 - DNA, 324 bp, Zea mays
  Clone ID: LIB3088-001-Q1-K1-C11
ggggcaagaagctgattgtccagaagaggagggctgcgctcagtgactttgacaggttcaaggtcatgctggcaaggatcaagaggggtggtgctatcaggcaagagctcgccaagctgaagaaggcgtccacggcttaagtcccttttggtggatggcatgttagtttttggtttcatgttgcatcagcattttgttttgagtgttgtcaaagccagaattagtaatatgtttcatgtgtacccttttcaaacttcatcaagaatgggtgtgctctggatattttgtcgggaatgatatgaaatacttaagttagcttgcgac

SEQ ID NO: 78824 - DNA, 304 bp, Zea mays
  Clone ID: LIB3088-001-Q1-K1-C12
attagatgcaacctgcaagtctctgcttcgagtgtactattggctggtgataaattaaaagtggtaccgaactgtttagacaatgatctcatgcgactatcagcagcaatgaaaacttggtacttggtacttggtagactatttcattggatattcggctgtatatgatccgatgtcttattttggggtgtgtgtgtgtatgcccccatcgaggacagtcgatattggctgtgtttatccccgaaacactattcttccttgagtcatggcattattaatgggtgctttttgcactcattgagtc

SEQ ID NO: 78825 - DNA, 283 bp, Zea mays
  Clone ID: LIB3088-001-Q1-K1-C2
aaaaaacatacaaaaataaacataaacaagaaaaaaacaaaaataaaacaaaaaaaaacgggattcaaaaactggagaaacagataaagagcaattaaacggaacagaaacgtgacatccccccattcatttcccctgtttatttacaggttcattttccttctggctgcggtcagctagccccatggctgtacatttctaggtcaaggactagtgaaaacgcggcattgttgaactggaccgtgaatgcatgtagccgcacatgtacatccttataaaattt

SEQ ID NO: 78826 - DNA, 390 bp, Zea mays
  Clone ID: LIB3088-001-Q1-K1-C3
cccacgcgtacgaatgggatcaaatgtgttattggaagcgtcgggctaaacttcccggtagtatgtgtgattgagagcaggatggatatcaaagggattagatgtgagtataggtgggagtggatcggatgcattgccatacgcaggcgtatacactgaagcatcaactgtactcctcactgcatgcctgtcctcgcctaaggcaaccactgatgaaccccgcatgccacacacacccacactgactcacacactcgccgacaactacagcaccaactccagtccccccaacaactgtctcaacaactgggtctgtcattcacgcatgcatgcataacgtcctcgtgaactacgactggtactacgacttcatgcatacggtcattgaca

SEQ ID NO: 78827 - DNA, 392 bp, Zea mays
  Clone ID: LIB3088-001-Q1-K1-C4
gaaaccttcgacatagacctcaaggagcagaaggtgacagtcaaaggcaatgtcaagcctgaggacgtcttccagacggtttccaagtcggggaagaggacctcctactgggagggcgaagccacggccccggacgctgcggcggctccagaagccgaagcagctcccggcaccgcggcagaagcgcctcctgctgctgctccggcggcgccagagatcaccccagccaaagctgacgcctgatcgtcacgctattattcactcacatgtgatgctgcggctgcgactcctaaaccttaaatctagaaatagctggggattgggtttgcattgcatcgtgttcttgccggtctaacaagtgactataagaataatggaaataacgatgaaaa

SEQ ID NO: 78828 - DNA, 298 bp, Zea mays
  Clone ID: LIB3088-001-Q1-K1-A1
cccacgcgtccgatcggggcccgcgcgctggaggcgttcggcaggcactgcaggtccctggtggggctccggcgggtgatgcacccgatcgacctggcggacaaggtgtgccagcacgacgaggcgcacgccatcgcgcgcagcatgccgaggctgcggcacctggagatggggtacatgctggtggcgacggaggcggtgctggagatcctggggcagtgccgcgagctcaagttcctggacctgcgcggctgctgggccgtggacgaccggttcctgcgggagcgccacccggggc

SEQ ID NO: 78829 - DNA, 141 bp, Zea mays
  Clone ID: LIB3088-001-Q1-K1-A10
cagaaacttcaaatgtggtttatgatccaagtccaagggatgggcagaacttagattcatcaccgacagctgtacctttggctgttacaatgaataaaaaagagcacgtgatatcagtgaataagacagacattagggtct

SEQ ID NO: 78830 - DNA, 366 bp, Zea mays
  Clone ID: LIB3088-001-Q1-K1-A12
cgccgtcatcgtccgccagcgcaagccgtggcgtcgcaaggacggtgtctacatgtacttcgaagataatgctggagtgattgtgaatcccaagggtgagatgaaaggttctgcaatcactggacctatcggcaaggagtgtgctgacctttggcctaggatcgccagtgcagcaaatgccatcgtttgagagcttgttggaatgtgtttagacttgagtatgatcatctcaattgtgtgttgcaggtgttgtaagggtgctattggacttgatggctccttttatgttggtcactcaattctgtagtgaacaaaatttctgggtgcctaagttgctgtctgagatgctataatattaatttgtct

SEQ ID NO: 78831 - DNA, 394 bp, Zea mays
  Clone ID: LIB3088-001-Q1-K1-A3
gccacgcgtgcgttttgtcatggcgtgcgcgccatgtacgccttggagtactggtgctggcggataccacttatgaccagggatcctcgtaatggctcgtgatggactaccaatggtagtgcgactatattgttcacatccatgctggtcgcaaacaatggagaaccaaccaaccaatctgacgagctttagattcatcaaacaaaatgaatccattcacctttttactcggaactcagcagatgtaatactttccaagaaatgagccttcattccctgccactttcatagtttctttcgctgatccacactgacatctatgatttttggagcaaactctgatctgttttgactagtttacacgtttgtgtgtggaatctgaagagctggtctg

SEQ ID NO: 78832 - DNA, 225 bp, Zea mays
  Clone ID: LIB3088-001-Q1-K1-A4
gcggggaaggggggtgccgcgaaaaagaacccacggcgccccggtcgccaaggaaaaaaaaaaataaaaaaaaaaaaaaaaaaaaaaaaaaaaaaaataaaaaaaaaaaaaaaaaaaaaaaaaaaaaataaaaaaataaaaaaaaataataaaaaaatataaaaaaaataaaaaacatattaataaaaaaaactataatattcattaatcaaatgaatacattct

SEQ ID NO: 78833 - DNA, 302 bp, Zea mays
  Clone ID: LIB3088-001-Q1-K1-A5
tcttactctgttcttatcgacttctctgctctgttactggggagttccgaattgctaactcagacagacagtgctgacaatgtgtttgtgtttgaatgtaaacagaacaagaacagaaaaatagaagattgatctgtcaaaaaaaaaagaaaaaatcaatacgtagatagcttattaaaaggaatataagctgaataagctactgaaggttgaatgggataacctgtctgtaaatgcccccatatgctctgggcctaagtcacgctacattaaatcatttgaagattacctgggcatgtttg

SEQ ID NO: 78834 - DNA, 455 bp, Zea mays
  Clone ID: LIB3088-019-Q1-K1-F6
gatgtgatgatatcatcaatctcattgcatttacgggtcaaggaccttatggaacggctgtcgtgcctggcaaggggggagggacgctggcctggctaccgctcggctctagtaacggaaacaggtatgtctcacatcattgctcgaagactggaaaaacatcaagttatctcagttgggtagagtgctggtctgtcactccataagtcgcgggttcgaaccccgttttccccgcacgatctgaaacttatagaatagaaggggccataaacaggatagtctataccaattcatttggtgtacttgaaataacttaattcgaaattgttccgtcaagtataagaaattaatataacaatgaataactcactcaatggattataccttgacacttatttatcttaatattcattccattcatgccattcttaagcaaacacgaaaaagcttatatt

SEQ ID NO: 78835 - DNA, 395 bp, Zea mays
  Clone ID: LIB3088-019-Q1-K1-F7
acgcaggactcgcttcaagctcctcatctcgctcagggggggtcgcctgagatcacagggacagtggtgaaggcagtggctgtcgtcgccggcactgatgtcaagggcaccatcttcttttcacaggaaggggatggtccgaccaccgtgactggaagtatctctggcctcaagccaggcctccatgggttccatgtgcacgcgcttggcgacaccaccaacggctgcatgtcgactgggccacacttcaatcctgttggcaaggagcatggtgcaccggaagatgaggaccgccatgccggtgatctggggaatgtgacagcgggagaagatggtgttgttaatgtcaatattactgacagccagatacctcttgctggaccccactcgatcat

SEQ ID NO: 78836 - DNA, 383 bp, Zea mays
  Clone ID: LIB3088-019-Q1-K1-F8
cggacgcgtgggtctcctcaccatttgggctcctgccgagagctcaccgagctcggaccgtcgaaaggcgcaagcccggtggacatgccgaataacacatgcaagctctgctcccggcgcttcaccagtccccgcgccctcgccggtcacatgcgctcccattccctcgtcaaagctcatgctgaggccgcggaggcagcgaatcggctgatctcttctgcatcctccacgtccaccttcttcatcgccgccgacgactaggacgtcatctcgaagattcccacttccacccacggactctaatagaatccgaatcgcagccttctgttactcgattccagtttatcatatcgcgaaagctagtctgaatacacctcatcgta

SEQ ID NO: 78837 - DNA, 311 bp, Zea mays
  Clone ID: LIB3088-019-Q1-K1-G3
tcgcggacgcgtgggcggacgcgtgggcggacttcgtgtgtggagaagctcaagaagatggctggcgcgtgtacgcaccggagggaagggcagcatgcgcaggaagaagaaggcagttcacaagaccacgaccacagatgacaagcggcttcagagcaccttgaaaaggatcggggggaacaccattcctggtatcgaggaggtcaacatcttctaagacgatgttgttatccagtttcagaaccctaaagtgcaagcattcattcctgcaaatacatgggtggttagtggagtaccccagacaaaaagtc

SEQ ID NO: 78838 - DNA, 390 bp, Zea mays
  unsure at all n locations
  Clone ID: LIB3088-019-Q1-K1-G4
cggacgcgtgggtgccttgctgcgtactttgtctgcaatacaatattcagtgccatcagggcaatgatangcagtgaaggggattatgacatcaggaaaccatgcatcggaagcctatgctatgatttctctaatttggagaaatttctcaacctcaaatctgtcagagagagcctaggggttggagatatagagtttgtttcatgcagcccaactgtctatgaggccatgctattagattggatgaggaaccttgaagttggaatccctgaactccttgagagcgacatcaaagtgttgatttatgctggagagtatgacctcatatgtaactggcttgggaactcaaagtgggtaaactctattgaatggtctggaaaagaagctttt

SEQ ID NO: 78839 - DNA, 410 bp, Zea mays
  Clone ID: LIB3088-019-Q1-K1-G5
cggacgcgtgggccggcggtctgatcgggctggcgacggagagcgggctgttccggggcggcgggatcggcgcgagtgggcggcgcgctcgtctccatcgaggtcgtcgactcctccatccgcctctggcaggcgcgccgatccgggatctggagcatcctctacgtgctgaacgtgatctacagcctactgacgggcaggctggtgcgcgagaaggtcgacccggcggtgcatcgggtggtccgcagccagatgaacgcggtggactcgtcgccgttcagggagtcgccggacctgttcgaggtggatgccaccaacggcatgccgcgggcgtccatcgacaagctccccgagtcgtggatcaccgaggagtacaggcgcgacaccgtctgcgacctcttcggctgctc

SEQ ID NO: 78840 - DNA, 406 bp, Zea mays
  Clone ID: LIB3088-019-Q1-K1-G6
ccacgcgtccgggcacttgctcttcggttttctatggaagaagagcgctcaagggaagaggctattgcaaaagaggctggggaagatacttctaatacagaacataacaatgtcccaagctcaaacagtgattctgttatggctgaacgagaacctgcctcaaatgcttctactggtgacaaagaacaaccaaaggatgatgactatctactacaacaagcacttgcaatgtcaatggatggtggtgcttcaagatctgcagctttgactgactctgctatggcagaaactggtgcatttgaccctaacttgtcatttgctcttcaaatgtctttccaacatgcaaacatgtccagttacacttatatgaataaagtgttttaagacagaacgtttgtgtcatcta

SEQ ID NO: 78841 - DNA, 524 bp, Zea mays
  unsure at all n locations
  Clone ID: LIB3088-019-Q1-K1-G7
accgcccacgccgtccggtgaggggttgactttgcgttctaccacttgacgtaccaaagaactctgagcgcaggaataacctgctgttggctgcaagggcacggagcctggtactcgacgttccagcttgaagaagaacccaaagttcattccccttcaactggttcaaaggaaggcgccttggatgtggaaatgccttccaaagatanaagaatgtgctanngcctcttcccctgcaaaagcgacanagccaatgccaaccaaacggtgtgcagcccttcaacaagccaccacatcacaagggcagttcatcgcgtaaaggcccacaggaannaacttgtatttggctctggtggtagcccgaagccgaaaaagggcacctgaaaaggaagcagagtgagcccaagaatagaagaacccaaaattcgcagcattcacagtgaaagaaatactcactgaagggctgaataaataggaagacaatgtattatcagtatttccggtgacggacattctcagggaga

SEQ ID NO: 78842 - DNA, 228 bp, Zea mays
  Clone ID: LIB3088-019-Q1-K1-G8
gactcatcctaaaaaaaaaaaaaaaaaaaaaaaataagatttaaaaaaaaaaaaaaaaacaaaaaagacatggttaacttagaaaaagctccaagccatacaacaaacccttcctaaaaaaacctatactataaaacaactccattatccaaaatttatcaacctctaaaaacaacataaaaaacttaaaaacccatacaaataacactttcttttactcatcccaac

SEQ ID NO: 78843 - DNA, 314 bp, Zea mays
  Clone ID: LIB3088-019-Q1-K1-H2
ccgacgtcatcgtccgccagcgcaagctgtttcgcttcaaggactgagtctacatgtactgcgaaggtaatgctggagtgatggtgagccccaagggcgagattaaaggatctgctatcactggacctattgtcaaggagtgcgcttacctttggcctaagattgctagtgcagcaaatgctattgtctgataccacctgttgggaggctagttgagatagatttcttgtgatccattttaaccttttctgtacttaaacatttgatgaaatttactcgtttaatgtacttttggaaaagactcttaggcgcac

SEQ ID NO: 78844 - DNA, 402 bp, Zea mays
  Clone ID: LIB3088-019-Q1-K1-H3
acgcgcttgcagccgccgccgcgtccgcctggttaagctcagcagccgccgcagcacatcgctctcttgatctcagccgtggcggaggtggagcaacaacaggacacgccgaagctcttcaaccgctggaccttcgatgatgtccaggtgaacgacatctcgctgaacgactacctcgctgtgaacgcgacgaagcacgcgatgtacctgccgcacaccgaggggcgctactccaagaagcggttccgcaaggcgcactgcccgatcgttgagcgccttacaaacttcctcatgatgcacgggcgcaacaaccgcaagaaggtcattgctgtccgcatcatcaagcataccctggagatcattcacctgctcaccgatgccaaccccatacaggtcgtcgtc

SEQ ID NO: 78845 - DNA, 431 bp, Zea mays
  Clone ID: LIB3088-019-Q1-K1-H4
acggcgtgcgagtccgatcgatcgatctgaaggctgctgtaaagaggaagatggaaggaaggagtgaggagcatgtgagttgctgtgctgctgtacaaattaaacttagctcttagagtgaggagaaagtaagctgttagctgtctgcctaaaggaaagaaaggaaaaaaagaagctggaagccatcggcaccctgtttcatgtgttggtatagctgctgtggttctcctgttgtctgtctggcctttgttgtaacataaagctgaggcgcactagcctgccttcgttttcacagttaagctgaagttattagtatcagctttcctgaactgcttggtatgtaatgtgactgtgtttcttacttgtactaatgcttgtctcatgtaatccaggcccctgatgtctgaaatgtttaatctcaaattttcacc

SEQ ID NO: 78846 - DNA, 92 bp, Zea mays
  Clone ID: LIB3088-019-Q1-K1-H5
acgcccacgcgtccgcggacgcgtgggttctatcccatttggtgtaatattttcactgctattgtcaatggaaagccgtcggttgtatcccc

SEQ ID NO: 78847 - DNA, 465 bp, Zea mays
  unsure at all n locations
  Clone ID: LIB3088-019-Q1-K1-H6
cccacgcgtccgcggacgcgtgggggcgtatctaccggcggcaaaggcgctcttggtccggcctccctgcggtgcgcggtacgacagtcgacaggatggcaatggccacatcagcatcgtaccctccacctcctccattttaccgattgtacaaaaaatttgagcaagatccctcatctgcaccagaacctccaccaccaattgatgaaccattcaaagccttgggtgttgattacacaggagatgttgtgattccaagcttggagagtcataatgtccgtcagctttatccaaagggtcccaatattgacttcaagaaggagcttangaccctcaacagagagcttcaattgcatattttggagctggcagatatattagttgagagaccatctcaatatgctcgtagggtagaagatattacgctcatattcaagaacttacatcatcttctcaattccttac

SEQ ID NO: 78848 - DNA, 465 bp, Zea mays
  Clone ID: LIB3088-019-Q1-K1-H7
tggaaaggtggagtgattttgggcgtcctttatattggtaaggatgcgtggattcgtagagaagattgggttaaaaatggtgtccacatcgggagtggcagaaaatataaggattcctattttcttcaggcgcaagtaatgtgctactacaacgtataacagtatcttatttccgagctacacacgaagacttgcacttatacaggttgttcgaccgtccaaaccatcctagaatatgattggtggactgcgattaaattgcgtacatgatgcatcagttctatgcatgctcgctgctgtctgttcggaagtcatcaactcgggacctggactaagggccttgtcgttcgctcaacccctatgaaaaagtttggctttctaaagatgtagtagaagtactcatttattccctgccaattgaacatttcaaatcttcgtatgggtgtaatgaaaaatcttgatgtt

SEQ ID NO: 78849 - DNA, 374 bp, Zea mays
  Clone ID: LIB3088-019-Q1-K1-F5
acggttataggaaggtgttgtattcagcatggggtatgtgattgattttgtcttgctcgcgtcggaaccttggcaaggaagtgtggccgtatggatcccttcactttacaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggaggccgttcccttataaaatcaagaaagaaactcacttcaatttgaaaaaaacaatgccccccttatcccccacccttgtggtttttctaaccttttttgccattgaggccacgggtaaaccccttaccgtt

SEQ ID NO: 78850 - DNA, 313 bp, Zea mays
  Clone ID: LIB3088-019-Q1-K1-H8
ctctactgcacctcgatccacatgttccggttcacggacgacgactggcgcgccgtgcgagccatgctgctcaggcattccgtcagccattaccaacaccacctaaccatggactcccactagctccatgagctcgcggctctcctaatgaacccactggacactgaacacctcacgctgcactaagtcttcaacggatgccgtcaactacttcgcaccgacgatgtacgactcctgcacgaagaccctgagcttctgcacctcattgacgaacccagcgctgactttgattccacataccgtcattgcggct

SEQ ID NO: 78851 - DNA, 339 bp, Zea mays
  Clone ID: LIB3088-020-Q1-K1-A10
aattaattctcgacccacggatgcgttcgttacacctagtgtatattgttgctcaactttataagttcctcttgtatatcaagcgaggttaaaataaaatggccgaaaggtataacaacttgcatctgtacttttacttctactctataagtcgtgtccagaaacgactattacttaaatttgcaaacccccatttaaatgcatcatggctgcagcgtaatcagagcgtaactctaggtagcacttgatctgcaaacacacatttgattttctcatggactcaccataaatgagagattgatagtactttcattatataattcacacatcgcgtttcta

SEQ ID NO: 78852 - DNA, 441 bp, Zea mays
  unsure at all n locations
  Clone ID: LIB3088-019-Q1-K1-D2
acgcgaacattcaggtcacggaggtgcagacgcttatcatgatagaccagttctactgcgacagggcgaggtgcatgaaccagacgtcggcggtggccgtctcgggcgtccagtacgaggacgtcaggggcaccttcaccgtcaggcccgcgcacctggcgtgcagcgacagatcgccctgctcggggatcaccctcgccgggatacagcttcagcccctgccgctgtcgcagcaccgtcgnctgtcgtacgaccccttctgctggcaggcgttcggggagctgttcaccctcaccgtgccccccataccttgcttgcagatcggcaggccggcagcagggaacagcgtgctttccgacggtgacctttgctgaaacgccgatcggttcatcagttaagctaaggcggtcgtcgtgatgctttcgaccactgctttgcacg

SEQ ID NO: 78853 - DNA, 151 bp, Zea mays
  Clone ID: LIB3088-019-Q1-K1-D3
acggagtgatctgatgcctagcagtaccttgtttccagtatgcggtgatgcgtaggctgcaggggggaggaatgtgcttgtatgtgtatgtgtcctgctgcaagttgtcctttgctatttagaatggaagaagaaatgccttgtttctctg

SEQ ID NO: 78854 - DNA, 367 bp, Zea mays
  Clone ID: LIB3088-019-Q1-K1-D4
gacgagaagtcgctgcagaaggcggttgctcaccagccaggtagcgttgccattgaggccggagggcgggagttgcagctctacaaatcgggtgtcttcagcggaagctgcaccacgaaccttgaccatggtgtcgtcgcggtcggctacggcgccgagaacgggaaggactactggatcgtccgcaactcgtggggcccgaagtggggcgaggctggttacatccgtatggagaggaacgtcaacgccagcactgggaagtgcgggatcgcgatgatggcgtcctacccgacgaagaagggcgcgaacccttccaggccgtcttcaaccccgccaacaccgtcggctgcccctgacaatgtctgcg

SEQ ID NO: 78855 - DNA, 484 bp, Zea mays
  Clone ID: LIB3088-019-Q1-K1-D5
gaattcccgtgtgggccgacgcatccgcttggagatgccactggtatacttctatggtcacccaaatgcaagtattaatgcgggtgtgtacaaagttgcttgtgggggagctagctaaaacattggagaaacagttctctggcaatgctgaatctagggcagcaggaatggttatcaatacaatggggtgggttgaaggccttgggtatgagttacttctcaacgcaattgaaaccttcaaggccaatgtagtactggtactgggacaggagaaactctggaagatgttgaaagatgcagttcaaagcaagtccaacattgatgttgtaaaacttcataaatcagagggtgttgtcctcagaaattcaaaatatctgcaaagaacgagaaagcttcgaatcaaggaatacttttatgggattgcaaatgatcttgcaccgtactcaaacattgtcaatttcagtgatgtctccgtgtataaaat

SEQ ID NO: 78856 - DNA, 457 bp, Zea mays
  Clone ID: LIB3088-019-Q1-K1-D6
cccacgcgtccgctgacgcgtgggctcgcttttcgttgcctgctgccgattgccggcattgtgccccactcactggcggtgtggatatttcgtttggttctcctttccgtcttgtccgtcgccgaggccttcttcccctcgctccccagctccagcaagcagatcatatccatccaaccacgaacaggaaggaaggtacgaggcctgaagggctgggctgaagttgaaccatgagtgccgtcgcggtttcgtcgtcgctgaaccctaacgcgccgctcttcatcccggcggcgctgctgcaagtggaggacttctcgccgcagtggtgggacctcatcaccaccaccgtctggttccgcgaccactggtcccgctagcacgcccacctggatgagatagccgagcagctcgagttggtcgccctcctttcctacgatgaagatgaggacctcttcta

SEQ ID NO: 78857 - DNA, 282 bp, Zea mays
  Clone ID: LIB3088-019-Q1-K1-D7
aaaaaaaaaaaaaaaaaaaaaaaaattgatttaaaaaaaaaaaaaaaaaaaaaaatgtaatgtaaaataaaaaaaggagagaaagaaaaataaaaaaaaaaaaaaaaaaaaaaaaaaaatccacccattttaaaaaatccaaactttccttccccctttcttccaaccccaatattttttttttcttccctcctaaatccatttcctttcccttctttttccaacttcttccctcgaaaaacctctttattccccaatttattcacctttcttaacttcccc

SEQ ID NO: 78858 - DNA, 68 bp, Zea mays
  Clone ID: LIB3088-019-Q1-K1-D8
aaaaaaatcacaaaaaaaaaaagtttttattaaaaaaaaaaaaaacaaaaaaaactgtaagagttaaa

SEQ ID NO: 78859 - DNA, 278 bp, Zea mays
  unsure at all n locations
  Clone ID: LIB3088-019-Q1-K1-E1
caccaacacgcgcgttctcgtgaacgggtgttccatcggcggacaccctacaggatccgagggcgctgcncagtggatgccggagaggttcatgctatacggctggcacaagtccaacaactacagcggccattacttcatgtacctgtcgatcaactctgggcgcccgatctgaatcggggtcaacttcatgctcgcttaccatggagatcatgctcgccaacctcatgtaccattttcactgttaagtacccaatcacaaggaatacggtgaatgg

SEQ ID NO: 78860 - DNA, 304 bp, Zea mays
  Clone ID: LIB3088-019-Q1-K1-E2
cccacgcgtccgcccacgcgtccgctagcttgagtcgaccgcacaccacattgaagtacaggttcaggaagctggtggggctgaagaaccagaaggaccagcatttctcggatctgatagtggagcagaaggaggagctgaagaatcgcgccaaccagttgatacagacactggagagctgtggctgggaagctgccatcggttgcggtggcatctcgatgctggcgaagcccaccgcgtacatggggaaagccttcaaagctgctggctttgacagcgagctggacgcgagcaacattcggga

SEQ ID NO: 78861 - DNA, 368 bp, Zea mays
  Clone ID: LIB3088-019-Q1-K1-E3
acgagcgcatgctgtctgttgctactggcgtgttcacgggttcctccggcgttaagatctcggggtaggtgtgcccggtccactggcactaccgcacccggtcccactcgtgagaactgacagcggggcactacgacatcacgtcgcactacctgtacgcgcgcatcgtgcgcatgctgacgcgccactgcgccgtgctcaactttacctgcgtctagatgctcgaccacgagcagccgtatgacgcgcagtgccatcccgaggcgcttgtgcagcaagtggccgtcgcggcgcgggaagtcggcgtcggtctggacggtgagaacgcgctgacgcgctactacgacacggtgcacgaccagttgggg

SEQ ID NO: 78862 - DNA, 396 bp, Zea mays
  Clone ID: LIB3088-019-Q1-K1-E4
acgggactaccctgagaagccaccatcagggctatttcattcaagaataaacttaacatgcgtgaatcgtgaaactggagtggtggacccgaagaagttcagcgttctgggtaactggcagcgtgattactcaatggaatacatcctaacccatctcaagaaagagatgacatcttcacagaaccgcaagctagttcagcctccggaagggacattcttctaaagatggcagcaactcatgtccatccatggtgactcggaaacagcttccgcacctggttcctatattttatatatttagtctgatctcccagttatctgtaaaccaccgagatcgagtgcaagcagacttggttgatttacaatttgcccggtggttgctaatgatatgggatg

SEQ ID NO: 78863 - DNA, 430 bp, Zea mays
  Clone ID: LIB3088-019-Q1-K1-E5
gcactcgtacgcggactcgttggaaaaaaaaaaaattaaatttaaaataaaaaaaaaaaaaaaaaaagtaaagtataattaaaaaaggtggaaagacaaaaaaaaaaaaaaaaaaataaaaaaaaaaaaaaaaaataataaaaaaaaaaaaaaaaaaaaaaaataaaaaaaaaaaaaaacgcctccttttttaaaaattcaaattttataaacccttacttccaatacattcattttttttttctgccccctaatttaaattaatttccccttttttaaaaactattaaattgaaaaaacctttctttaccccaatttaaaccttttaaaaaaaaaccctttttcccaattttactaaattccaaaaaacccctaaccaatcccctttccaaaaattttcccaccctaaatgaaaaattgaacccccttt

SEQ ID NO: 78864 - DNA, 451 bp, Zea mays
  unsure at all n locations
  Clone ID: LIB3088-019-Q1-K1-E6
cccacgcgtccgcgctggccgagtcgggctgcttcgtcaaggcacccggcggcgcgcccggcaacgtcgcctgcgccatcgccaagctcggcggatcctccgccttcgtcggcaagttcggcgacgacgagttcgggcacatgttggtgaacatcctgaagcagaacaacgtgaactcggaggggtgcctgttcgacaagcacgcgcggacggcgctggccttcgtgacgctcaagcacgacggggagcgcgagttcatgttctacaggaacccgagcgcggacatgctgctgacggangcggagctggacctgggcctggtgcggcgcgccaaggtgttccactacggctccatctcgctcatctccgagccgtgccgctcggcgcacatggccgncatgcgcgcagccaaggccgcgggcgtgctctgctcctacgaccccaacgtgcg

SEQ ID NO: 78865 - DNA, 338 bp, Zea mays
  Clone ID: LIB3088-019-Q1-K1-E7
gggggaacagctggagagaggccttttcaatgccgccatcgacaggctctttggcgccaaggaacgtgaggagagcggggagaggatgaaggaattcaagatcgctgcggccaaaggcatcggcatcggcgtcgacgtcgacgaaactgcgtctccccgcacggatttaaccgatttggttgatctcataaaatccttctgagctcatgacgatcgatctgttgggtgatgcctactctgtccatcgtgctcgacttgtcttcctactactgtaccactgtctgtgctcacttccacgttcctgacggtgttgtgatctagcgtatcattgtgcgatc

SEQ ID NO: 78866 - DNA, 285 bp, Zea mays
  Clone ID: LIB3088-019-Q1-K1-F1
acggtcgccgaccccctccggctccaagccctcttgcggcgccacggccgcgccgtcgccgcagcctagcgccgcgccgaaggccgtctgcgccagctccgtagccgcggctgtcgccacgtccctgctctccctggccgcggccgtgctggcatgatcacttgatcaggatcgtgtagtgctggccaggggacggcgcctttgtgaattgtgagagctcgtactgtgtctgtgtgactgtctctgtggccgtatgagcatttagccctggatctgtgtttgttg

SEQ ID NO: 78867 - DNA, 345 bp, Zea mays
  Clone ID: LIB3088-019-Q1-K1-F2
attttgtcaaccgcaaaggagatgatggctacaccactcacaatggcatcgtggggcgagggtatgcatgttccgagctacgagtctgttagccgcaagtttcactcgaagtgagaggatccagcatgacctgttccaacaactgatgtgaagcctgcaacggccctcagctgggacagttactcccccacagaataaaaacctcccatgtgggttctagcgccccccctaattactccctctgcatgtatacgccaaacatgtttttttttgtggtaagaatcatcaagccccttggcgactcgtttatgagtttcgcagcggcgctagattttattttatgtg

SEQ ID NO: 78868 - DNA, 373 bp, Zea mays
  Clone ID: LIB3088-019-Q1-K1-D1
cttcgtatcttcctccgaatatcattccgagcgttcatcctgttgtgggggcggcacacccttgggaagcgagcgagtttgctctatggctgactgatggtggtgtttttgtgttggaacctttggaatcggagagaaaatggggaaatcctccaccagtagagaatgggtctgctagcaacttgttcacaccgccttctaatggagcttcaagttctgaccaaccagaaagatgattaagaagttggaactggtagatttttcgtggcacgagtcttaccaacaaagacagggctttaaagggtggtgcgactaaccttggcagataggttccaagggagcctgacaacgcgctcaataaaaataattcaac

SEQ ID NO: 78869 - DNA, 264 bp, Zea mays
  unsure at all n locations
  Clone ID: LIB3088-019-Q1-K1-F3
acgcagcgtcaccgttcgtgctggcgttgccgtttactccatcgagttcacctatactgacagggctgggcanaagcgcgccgctgggcgtttaggtggacttggcggcaatgttcgaacgatcgacctttgcaacgccgaggatgtcaaggaaatctcgggaacatacggcgcatttgaaagtgccactacgctgacctcgctcaagctctgtaacagcagcagaaacctggggcccctggggggtcgagaacgggacgcgtt

SEQ ID NO: 78870 - DNA, 401 bp, Zea mays
  unsure at all n locations
  Clone ID: LIB3088-019-Q1-K1-F4
catggatgaacaacatgatggactttggcttcccgtacctgttgcagttcattcgtgaatgcacgagcaaggtggatgattgagtgaangacaagattgagtcgcagaaggaagaaagagccaaagagaaggaggagaaagaccttgtggctcagcagaacatgtatgcacagctgcttcctctcgctttgcccgccccgccaatgcctggcatgggtggcccttcaccttcgatgggcggaatgggcatgccttcgatgggtatgccgccgatgccagcatttgggatgccaccgatgggaagctactgatttggttttgcagcataagtggaacttcattggagttgtagatggttgacagtttggaatcaatattcttcattgtaccaagaaactttt

SEQ ID NO: 78871 - DNA, 412 bp, Zea mays
  Clone ID: LIB3088-019-Q1-K1-A7
acgtgatgcacagaagatgatgcagatttgtggtggatttggatttaacccaacaatgagttggggagcagagaaagacgggctggatatcatgcagcatgactgggctctacctaagatggagcggcacgcagaagatgtgttgaaacagttgctgaagaaatgactcgaacggttgggcttctgggaagcaacactcgcgtcgcgtcttccagtttttgttgaagccagtttggaccaggaattttaccatttctaaatgtattatttataactagctactataacacccttagaaggtggagacccggtgttgtgatacttaatataagtagaaaaaacgtaattctgttactttattcttctgatatttatgagcatcgtttaagcactcgtgtggtgatttcttttc

SEQ ID NO: 78872 - DNA, 294 bp, Zea mays
  Clone ID: LIB3088-019-Q1-K1-A8
aaaaaaaaagacttgatttaaaaaaaaaaaaaaaaaaaaaaaaggaaagttataaatagaaaggcagacaagatacaacaccatcaaaacatcccccctttcattcacccccatttcctctcataactttccaattcattcccctaaatacatttcacttaccctcaattaacatcaccctaaatttacaaaacccttacttaacaaaccttaatctactctaactaaatcccctttcctccaatccccatattacccattatctccttacctatcacccttacaaccattttc

SEQ ID NO: 78873 - DNA, 269 bp, Zea mays
  Clone ID: LIB3088-019-Q1-K1-B1
tcgcactggtcaacatccatgatcgtttcgtccataacacgtggactgagaaatcttgctctcgtgggatgtccaagatggggacactacattatagctgctatactattggaccatccaatacaacattgttacgccagaaaataccattcatgttataagactccaggtattctggatttaccccaaatttgtcagatcctcatttagaaatatcccgaacttttgaaccatcattgccttatattcataatggctctcatatcaac

SEQ ID NO: 78874 - DNA, 350 bp, Zea mays
  Clone ID: LIB3088-019-Q1-K1-B2
acgggcagcagccaaaccctacataggcgccgtttcatgcggccgccccgcatcgtcgccaaaggtgcggatctttgtgaagactgtgacggggaagaccatcactttggaggtggagtcctcggacaccatcgacaatgtgaaagccaagatccatgacaaggagggcattcccccggaccagcagcggctcatcttcatcggcaagcagctctaggacggtcgcaccctcgccgactacaacatccacaaggagtccacactacacctggtgctccggctacgcggcggcgccaagaagcgttagaagaagacgtacacctagcccaaagcagaaactttgatgaatc

SEQ ID NO: 78875 - DNA, 175 bp, Zea mays
  Clone ID: LIB3088-019-Q1-K1-B3
cacgcgtccgtgcttctccaaaaaaagaattaaattaaaaaaaaaaaaaaaaaaaaaaaatgtaagtaaaaaaaagaaaaaaggaaaaaaaaaaaaaaataaaattaaaaaataaaaaattaaaacacaataataaaataaaaaaaacaaaaattcaaatcaaaaataaaattaa

SEQ ID NO: 78876 - DNA, 388 bp, Zea mays
  Clone ID: LIB3088-019-Q1-K1-B4
acgcttgtgtaaaaatttgaattttggtatcgactctggacagccgcatagcaatggttggtccgaatggcgttgtcaggtccactgtactgaaactaatttctggggatctgcagccaacttctggaacagtatttcgctctcccaaggttcgcatggctgtattcaatcagcatcatgttgatggccttgatttgacggtgaatccccttttgtacatgatgaagtgctatccgggtgtgccggagcagaagttgagggcacatctgggttcgtttggtgtttcgggaagccttgccctccaatctatgtacactttatcaagtggtcagaagaatatggttgcattcccgaaaataaccttcaagaagccgcacatcattcttct

SEQ ID NO: 78877 - DNA, 479 bp, Zea mays
  Clone ID: LIB3088-019-Q1-K1-B6
acggccggcccgctccgtcccagcgttgacgccgtcgagtctgccgtcaagggcgtctggggcgccgtctacgaccggttgggcggcctgccgctcgacgtcctcgccttcgtcgaccgcaaggtggacgacacggtgcacgaggtggacaagcacctcccgggcgcgctgaaggcggcgtcggcgcatgtctacgcggtggttcggggcgtgccggaggtggcgcgcgagctggcggccgaggcgcagcggtcgggcgtgaggggcgcatcccgtgcggcgctcgcgatgacggagccggtggcgcgggacgtgtacggccgcgtggagcccgtggccaaggacctctacgtgcggtacgagcccgcggcggagcacctggccgtctccgcctggcgctcgctgaacggcctgccggtgttcccgcacgtcgcggagatcgtcgtgcccaccgtcgcgcactgggccgacaagtacaa

SEQ ID NO: 78878 - DNA, 400 bp, Zea mays
  Clone ID: LIB3088-019-Q1-K1-B8
ggccgctgcccagtgcccactgcgctccgctttaggaatctgacagagagactagagagggggaaagattcgaaggctggcatgggctccccttcctccctccccgccaacacgacactcatgctcctagccctgctctccagagcccaaagccgctaggcccaattctacacctcagacgccatcacggagaacttcaacaccatctaggccatcatgtactgggtccccttgcacaaggccctcaccacctgttacagacagcccaactgcgcctgcccttacgacaaccgtagtgcgtgcggcttcaagcacaccaaccagtaccccttcatgtccatagactcctactgaaaccatacattgttcaaggactgcaaggcatgctgctcctgctaca

SEQ ID NO: 78879 - DNA, 458 bp, Zea mays
  unsure at all n locations
  Clone ID: LIB3088-019-Q1-K1-C1
acgcttgagactatgtctntggctaaagctgttatacttttccgtgaagttggattgagacaggttcgggttctaccgaaagcttgtaagagggcacctgttgtcggcatactaacaagacatgatttcatgcctgaacatatattgggccttcatcctttcctctttaagagtagatggaagaaggtgcgacttggcaaggtaaaagttaccaacatattttgaagcttgctggtgactggtgatttggggaggtcacagaaggatcatccgaagctgtatacctggtgtcaaatcatgtattttgcagagaataactcaacttgaaaactagtggatcttacttcaagaaaataatttcgttgtaaatgctaagaagggatggaacatggctgctaaatgctaacaagttattttcccacgaacaagangaatctcacttgtaaattattatgcat

SEQ ID NO: 78880 - DNA, 290 bp, Zea mays
  Clone ID: LIB3088-019-Q1-K1-C2
atttgcttgacttctgacgagtaagaaattggcagcaagttcagcaggggccagactaatgaatgagcttgatagcatccttgcagcggtgccttggactttggcggttagaagaggtttataattttatatgatgaaattatgtgcatcttcagttgtttttgcctcactgctctgtaaggacatataaaattggtatttgtactttctaaagttctccttggaatggtagagttttacagggaacctttcatcatcagttgctgacatagctcgaactcgacgtttct

SEQ ID NO: 78881 - DNA, 361 bp, Zea mays
  Clone ID: LIB3088-019-Q1-K1-C3
acgcccacgcgtacgtccacgcgttcgggcgagttagccatcaggccaaacatgccttagttggcatgaggacaccgctcgcagggattaggtagagcaattttggcagatgctgaaatacggtgtgggtgtggcctgcgcattcattgcctgcagacaataataaggtgcttatgttcttgcaacaaactgcagcacctgaaattctgcgtcatcatcactgccctttccaactcagcagagcttgaagatggcagcagcttcatccgcagctggttgttgcagaagcaatgatcatcatgactaaatctgacagtaatgggttcgagagagatgctaagatgttgatctttttttgggt

SEQ ID NO: 78882 - DNA, 488 bp, Zea mays
  Clone ID: LIB3088-019-Q1-K1-C5
aattcccgggggcgccgacgcgaccgaactagcagcagagggttcaagatgccggtttcttgagtcccaaattgctgctgcgcggggtagactggaatcggctggttgtttggagaatgaactagaagtattgcatcaacatatatctcaggtggaggaaaccattgcaactactcagagaagaaaatctgggggtgtttggaagtgggtggcgggtagtacagaggtctctgacgatgaatagttgacaagcagcttccgaacaggaaacgtaagcggaggatctgctacagttttgaggcagcttgtctgttgccagttgccgggtgcttcctcaaggtcttgctcatggttgatctcgaaaatatgtctcccgaaataatcttgtttatcttcttcggtggtggcacctggtagaaaattttcctgggcagtcttagacattaattcaacaagtaaagcataacatcatgcaagtataccaaata

SEQ ID NO: 78883 - DNA, 468 bp, Zea mays
  Clone ID: LIB3088-019-Q1-K1-C6
gactcgaacgtcgtggccactggggaagtgtaccctctggatctcacggacgttgcagcctgtagggagggcatgactgggaatgtggtcagcgtggaccttgctaactccgtttttattaaccacacctctgacaaggagtacaagctgaaaccaattggtgatgctggccctgtaattgatgccggatggatctttgcctactcccagaagacaggaatgattgcgtcaaaagctgctgcatgaaggaaagcttaagcatccgatcctcttctgagatgaagaagtaagctggagttaggactaagagttactgcacctacttgatgtcgacggtgtctcaaaataagttgcggcctacctaaattatgatgaatcaatcaatttggtctttgtcacagatcgtttttttttgtttgctactagtacttgtacaattgtactcctgcctgctactgtccttatctg

SEQ ID NO: 78884 - DNA, 416 bp, Zea mays
  Clone ID: LIB3088-019-Q1-K1-C7
cgaagctgtcaggatgtccaagcgcgccttatggggagtgatggcaagccacaggagtggcgagacagaggacacctgcagggctgacctctcagttggcctgtctacgggccaaatcaagacgggagctccttgccggtctgagcgcctggccaaatacaaccagctgctcaggatcgaggaagagctcggtgatgccgcggtctacgccggagcaaagttcagggcaccagtggagccctactaagaaaggaagaggatggggatgttttcttgtggagctatactagctcgctgctgccttttgttacaatgtttgtacggtcgcaataaatgtatggtcctgtttgctcgagagctactcaggtgattttgtcgtgggagcaccaaaagcagaaaagaactgtttttttttc

SEQ ID NO: 78885 - DNA, 404 bp, Zea mays
  Clone ID: LIB3088-019-Q1-K1-C8
cacgcgtccggcaggccgcaggttagagtttttgcagccttagccaaagtgtaggacaggttcaatcttgtgagagagcatcttggataacctgtcacctcgaccatgttcgtcgtggccagttgtagacgtcttggttgtgcaagaaagtttctctcgaggacagttgctcgttttgttaaggccatcaatttttttgggcggcttgtaagttatttgagaatcccacctcaggttgatgggttgtattctcgagtcgtcaaattttagtaccggtactgtgtatattgtatatggtttcagttgtctataacgttgcggcttcattgactgtctgtggtataagtttttattattttttaatttttttgtcaacaagacattgtaattggtgttagattgtt

SEQ ID NO: 78886 - DNA, 456 bp, Zea mays
  unsure at all n locations
  Clone ID: LIB3088-005-Q1-K1-A2
gcggatctacagccaccttggtcaccggcggcgatggcgagttccaagtccggcatccctatcaaggcagaacaagattcggatggctcggcacaaagcacagctgatatgacggcttttgtgcaaaaccttcttatgcagatgcaaaccaggttccaagctatgtcggagaacatcatttcaaagatagatgaaatgggtgcgagaattgatgaattggaacagagcctcaatgacctcaaggctgagataggcggtgaaggcatgtcgacgccatctaagatgaaggaagagtcaagaccttcggacagctccgcatgagtgcagcagaagcagcatgactcgtttcagaggccgttgctgtgtcttgcgtttattactaacaaatactcctncgttcttttttatttgttgcgttttagttcaaaaatgaactagcgagcgacaaatatttga

SEQ ID NO: 78887 - DNA, 328 bp, Zea mays
  Clone ID: LIB3088-005-Q1-K1-A3
cccacgcgtccgcccacgcgtccgcccgtggaggctccgcccgagctgcagatctaacgggctgccggacgaggaggctgacagcagcgtagctgtgctgctgcgtggcatggcgtgctccgtccccgggtgaacttcccccagcgtgtggcacgggtgggggcaaccgttgcgggcccacctgtaagtgtcaggccggctcgccgccgtggctcggtagcctaggacttctccatgtcttgctctgctccggagtaagataccgcggattttaataatgaatcatggcatcaaataaaaagctgtactcgccggagcgatctgtgtc

SEQ ID NO: 78888 - DNA, 164 bp, Zea mays
  Clone ID: LIB3088-005-Q1-K1-A4
gcagcccactcgtcagccgcatctatagagagttatggagtctcttgtacaacgaatgtcactatcgtaaggggatatcaggttgagataagagcaactttcctagttcgtcgctcgcttgactgctgacccatatgagcttctctaccacctaggtcatgccc

SEQ ID NO: 78889 - DNA, 294 bp, Zea mays
  Clone ID: LIB3088-005-Q1-K1-A6
cccacgcgtccgaaaaaaaaaaaaaaaaaataaaaaaacaaaaaaaaaaaaaactaaaaaagggcataaaaaaaaaagaacaatgaaaaaaaaaacgcatgctcgcttttcagtccccatccttacttactcttgcctgcaacattcctacctttttttttagtcgctccctaaatttacattcacatggccgttcttatccaactttatcactgtgaaaaccctctcattccccatgttattctccctgatatacctccccctttctccagttgtctcaataacgtcaaggcc

SEQ ID NO: 78890 - DNA, 276 bp, Zea mays
  Clone ID: LIB3088-005-Q1-K1-A7
acgcactgacattgcctgacttgatatacagattcaagagcttgcagaagcaatagggctaccggtgacacacaatgaccgattgcaaaaattgggcattcgtcccctcaaaggggttcttttgtatggaccctctgtgaccgggaaaaccctcatggctcgatcattcgctgcacagactaatgcatcatttctgaaattgtctggtccacaatttgtccagatgttcattggtgatggagctaaccttgttaaaaattcttttcagctaactat

SEQ ID NO: 78891 - DNA, 372 bp, Zea mays
  Clone ID: LIB3088-005-Q1-K1-A8
cggacgcgtgggcacaggctgaccccaccaacagcaagcgaaaatctcccgagggcctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctcta

SEQ ID NO: 78892 - DNA, 417 bp, Zea mays
  Clone ID: LIB3088-005-Q1-K1-A9
aggattttcactgtcgtgtcaaaaatgcaggagtctcaggctatgcaagaaaagatgccggaggagtcagcagagatggacatgagtgaattcaaggaactgtgggatgacgatgcacctatcccgggttatttttagtgtggaaacctgttttgttggatttatttctctgtagattgctccgtttgtcttgagtgctactgaattgatggcacaaatggctgataacccaaagtagcgttgctggtgcatgatctgacatgtttggatttggacttaagtgtggtatttcttttgccttatgtacagtagaatattatctacatttgaaggagccttgtatttactgtgtgaaatcggtgtaaagaagttgatatcagagatcttacccagacttaacggttgcatgtttaaaaa

SEQ ID NO: 78893 - DNA, 148 bp, Zea mays
  Clone ID: LIB3088-005-Q1-K1-B1
ccaaactgccagtaggttatcatgatgttacaagtgacattatatcactccctgtcccgatctaacaagaatggggaatgtgcagcttttacagctttacttaatcgttttgttcttgctagttgaaatgtggaatggattatgaatc

SEQ ID NO: 78894 - DNA, 430 bp, Zea mays
  Clone ID: LIB3088-005-Q1-K1-B11
gcgcccacgcgtccgtataattgtaaggtttgcaggtacagtgcctgcaaaggttgttctgcgagcttacaggcgctttcagggaaggtgggctgtgcaaccgaaatggaaccttctcatacaaggatcatttgcgagagtgtcagactcctgtccttgcattggctggagataaagacctaatctgccctccagatgctgtttatgaaactgtgaaactcattccgaatcacaaggtggactatagagtgtttggaaagccacaaggcccgcattatgcacattatgacttggttggaagccgactggcgatcaatgaggtgtatccatgtatcatagagttcctctctcgtcatgatggttattgatttgattatatgatgctaatacagagtaacttacaacaccatgttcatcttaaaggtttttt

SEQ ID NO: 78895 - DNA, 308 bp, Zea mays
  unsure at all n locations
  Clone ID: LIB3088-005-Q1-K1-B12
cccacgcgtccgaagagaatttgttggagagctgaatattacagtcgtgaaaggtactaagtttnccgttagagacatgctggcaagtgatccatatgttgttttaacactcggagggcagaaagctcaatcgacagttaaaaaaagtgatcttaatccggtatggaatgaagtgcttaagatttctgntcctcgaaattacggacctctaaaacngaagtgtatgaccatgatacgttctcagccgatgatatcatgggtgaagcagagatagatctccaaccaatgatcacagccgccatggcctt

SEQ ID NO: 78896 - DNA, 53 bp, Zea mays
  Clone ID: LIB3088-005-Q1-K1-B3
aaaaaaaataactcataatttaatactacattataaatcaacaactaaaataa

SEQ ID NO: 78897 - DNA, 170 bp, Zea mays
  Clone ID: LIB3088-005-Q1-K1-B6
ctcacgcgtgcgcggactcgtgttagcatttataggatgttccatgaccttcttgtacccgagaatcgctcgtgtggccatagacatctccatcacttattctgtatggaaggctaagaatggaactgacgcatgcaaagcctgtacttctaccaacaaacctgttacta

SEQ ID NO: 78898 - DNA, 426 bp, Zea mays
  Clone ID: LIB3088-005-Q1-K1-B7
cggacgcgtgggttggaatcaagtatgacccgtctactggtatttatggcatggactttgacgtcgttctggaacgagctggttatcgtgttgcacgccggcgcaggtgcaagtcccgcgttggcatccagcacagggtgaccaaagaagacgccatgaagtggttccaggtgaagtacgagggtgtcatcctcaacaaggcccaaaacacctcgtaatcattgatagtcatcaaacgacttgccctttagcactccagttcaagtataatctgtgtactatgaatactgtgtttgttggataccaaatgcactgccagttttgcgtctgtgcccataatttcatcttgatcagactagcagttatgaacaaattactgttttgatagtgttaaagtgagctcgccagcaaaatctgaggaacatt

SEQ ID NO: 78899 - DNA, 411 bp, Zea mays
  Clone ID: LIB3088-005-Q1-K1-B9
gacccacgcgtccgcccacgcgtgcgcgaactcatatgttcttttttaaactttaatattcatcatcttacaaggctaacggggcttttgaacagggccactaaaaccagacaacatcaccataaactaaaaaaattcatatgtccaaacagatcatacatattccttttaactcttctaaaaaaaatctctaatcttctaaaacaaccccacatacaaaaacatacttttaaccccaagtccaaattaagacttttacttaaacatgtaacacaactagtgctacttaacatactccatcactatattcttctacatataactaagacactttaaatgatccaaatttacttactcatgcataccaaaatataactcttatatatttatacctaaaatcaattcactttc

SEQ ID NO: 78900 - DNA, 438 bp, Zea mays
  Clone ID: LIB3088-005-Q1-K1-C1
aacaaagctgaggagttattattattgtccctaaatgaatgggccgcgactttagttgcatcatcttcacttcattctatttgggttgaagttttaggcgacccactcctaagaaggttacttctcaggttcatcttctgccgagcaactcattccctgttcaaaccaacaaaccataagacagagttcctgccgacctgcatgcctcctttgcctgagtctgttgatgcagagagcatgctctcccaaagctgtgtgctgcgagtcgcatcattctttggcgctgccagtcagttctcatttgctgaggttaccacatggcctgatgttgaccctgaggaggctgttgtcaccagttcttctggcagtgccaacaaaggtgtgcctgagacagccagagattcagacatttcaaactcatcatcatctttttgatgc

SEQ ID NO: 78901 - DNA, 443 bp, Zea mays
  Clone ID: LIB3088-005-Q1-K1-C10
agctcctggtctaaaagccacaaaaattgaaaataaaattggactcagaatggttcaaaatggagacataattctaaataaagtatttgtccctgaggaagacagattaacaggcatcaattcatttcaggatataaacaaggtcctcgctatgtctcgaattatggtggcatggcaaccaataggcatatcaatgggagtttatgacatctgccatcggtatttgaaagaaagaaagcaatttggagctccactggcagcttttcagctcaatcaagaaaagcttgtccgcatgcttggcaacattcaggctatgcttctcgttggatggcgactgtgcaagctgtatgagtcaggcaaaatgacaccaggccggtctagtttaggcaaggcatggacgttcaagaaggccaaggaagtggtttctcttgggcgagagctac

SEQ ID NO: 78902 - DNA, 441 bp, Zea mays
  Clone ID: LIB3088-005-Q1-K1-C11
gttcgtctgtatccatggccgcctcgagcaagaccatcgctgtcctcctcgccgcgctggtcctcgcgctggtcgcgtccgcggtggccagcaggaagctggaggaggaggacgctttcctgggaagcctttcgccggcgcctgcccccgccgagggcggagccgcggggctcgctagcggcacgccgggggcgtgggccgtcgccgctctggtctctctcatcgccttcctcgcgaactgagcgggtcctgcgatctggattgctgcgggcggaggggaacatttatgctcgccctgtttgttctaggctatcggttccagtgctgctgacctctcttttggctgtataagagaggattacgcaccgtttcattttatactacttatctgttaatctgttattcttgagatattcttttaccatatgtgttctttgccat

SEQ ID NO: 78903 - DNA, 274 bp, Zea mays
  Clone ID: LIB3088-005-Q1-K1-A12
tgggagtctaccacaccgtcttcgactatggcaagctgagggttggcttcgcagagtcgtgctagggatatggtttggcagcaacccgtccagaggcaaacgcgtaatttgtgtgtttatgcgaccggcgatgtgtgtatatatgctactacatgtttagtgatgctttccgagacctgagacaacgcccgtctgttttaacgtggcgcaagaataattctggttctggatgtaaaaaaaaaattaacaaataagataccaaagtaaattacat

SEQ ID NO: 78904 - DNA, 406 bp, Zea mays
  Clone ID: LIB3088-004-Q1-K1-G6
cggaatgaccgtaggagagtaattctgctaaaacaattgctgagaagagcacatgaggactgtcgcagtctgctttgcattgtatgttaagatacttcaggtctcagttttgattgatcaggttctgccccgtcgaaaaaaatactagctgctgctgctttacagggttttgtctcagcgtattggtggttgactattctcagctacttgagcatgggggccatgattctttgatcatcttgcatgtaactagctgattggtgttccaatgatgttgtatttgcagaacgattttttccttgtaaatcaccaacaaccaccacactaggctttttctgtaccatcatggacgggccacaagaatttacaattcaaagctttggcacttgccatatttgatgtcgtc

SEQ ID NO: 78905 - DNA, 488 bp, Zea mays
  Clone ID: LIB3088-004-Q1-K1-G7
gcgatcgctaatatattctggtgtgtgaacaggcaaggtcattctggagtctgcaattctgacaacagtggtcgtgctcagccttaccgcatacactttctgggccgtgaataggggcaaagacttcagcttcctgggtcctttcctgttcgccgccctcatagtgctgcttgtgttcgcactcatccagatcctgttcccactgggcaagctctcccagatgatctacggcgggctggcgtcgctcatcttcagcgggtacatcgtctacgacacaaacaacatcatcaggcgctacacgtacgaccagtacgtctgggccgcagtctccctgtacctggacgttatcaacctcttcctgtccctgatgaccctcttcagggcagccgactaggcgctctgctctcatcctgtctatctacgagtcggtgcctgaatgctcccgtggttaagctccggtacccagaattccagttccaagaatagag

SEQ ID NO: 78906 - DNA, 431 bp, Zea mays
  Clone ID: LIB3088-004-Q1-K1-G8
cggacgcgtgggtttttataggcactacacccgtgattattgtatctcactccggccaacaggaggctgtgacacgtacagagattaaaccataagaaactagtttatttgccagtggtcgtactttggacggcgatttggagatagtttatttgcagcggcatggccacagcccatagccccaggcaatcattgagctgacttcacaactagtaggatctaaaaataaaaaagaaaacttctgggcggcggattgtatactgcctcggctcgtccataatgctggggtctccagatactatgcagaaaacgcggcctcgctttgactccagatatacttaatttattctttcgaagtctgcaaatgaaaagcttattccacctgctgcttatttttatcttcttccaatggtggaaagagctgctgatac

SEQ ID NO: 78907 - DNA, 83 bp, Zea mays
  Clone ID: LIB3088-004-Q1-K1-G9
aattccctttcgacccactcatactcccactcgttctaaaaaaaaaaaaaaaaaatcaaaaataaaacaaaaaaaaaaataaa

SEQ ID NO: 78908 - DNA, 380 bp, Zea mays
  unsure at all n locations
  Clone ID: LIB3088-004-Q1-K1-H1
nccacgcgtncgtttgcgaagttcacccaggatttggcgctgatcggagctctgctcttctgtctgggcatgaagaactccatcccgaagcggcagggcggcaagaagaaggcccccaaggcgaagacgaactagggctgcttagatagctgcacgcctcaggtggggtgtatcaggagacaggtctatttcgaagcaggctcagcgcgatgcagcgaatgccatcgagctgcgcttttacatgtttatcatcagattccattttgcggcccgaacaaaggtgtgaccggngtgggttaggcgactagattgcacgattatgtacttgagatttgtttgttgaactgggttgccgacggttaaatctctccatttgattt

SEQ ID NO: 78909 - DNA, 217 bp, Zea mays
  Clone ID: LIB3088-004-Q1-K1-H10
tcgaaaacacatacggtctcttgcaaaatcactttatcatatgctcacaagactttattcacggaatcgcgacaatttaaccttacttcctagaagcatcaacgttcctcatgcccttcaagctctagtttccacataggacgcttcacatgaatagcaaaccctacattgattgctgctactcttacaaccatctcgactatatcaactaactaat

SEQ ID NO: 78910 - DNA, 230 bp, Zea mays
  Clone ID: LIB3088-004-Q1-K1-H11
tcgtccactcgtatggccactcatgcggagatttataataaacacgcacgaagtctctcgtggggtaagcattgtactgaatgttctcacttaacgcacctttgaatgtatatctgcacatctttcatagtgtgcacactataatcaagcaagacatcattatcttctgaggttttacatttaatttcagaattacttgaacaatactcacaccatatcacatatcatag

SEQ ID NO: 78911 - DNA, 409 bp, Zea mays
  unsure at all n locations
  Clone ID: LIB3088-004-Q1-K1-H12
cccacgcgttcggtccgtggcgtcggcggcgtgggcgtcaaggggcgccggcgcgcaggggcagcaggcgcgaggcgggaccgggacagcggcggcgtccgcgtcgacgctggggcggacgctggaggccatcggcgagcccgagagccccagccagagccaggtgtcgtcctctgcctccttcgggcggaaggtggcgcggtcgcgctccgtgggctgcggcagccgcagcttctccggggacttcctagagcgcctctacaacggcttcggcgactgcacgctccggcgcgtcgagtcccaccgcgagcccaagccccacaggatgcgcggcggctgctgctgcggaagcctgggcaacctncacggagctggcgcagacgacgctgacgacgaggacgaggacgac

SEQ ID NO: 78912 - DNA, 403 bp, Zea mays
  Clone ID: LIB3088-004-Q1-K1-H2
acgatcatggatccagcgaataattgtcatgaacagggagcgaggcttgaatgttcaaatgtcacacggcgagtttatgattatgtatcacctcctggtgtataattcctttgcttctcagatggatctaacttgctgcgacaagaacgagcgtgcccatactcatactactatataaccgaatacagcaacatatgataagtcatctgtaacaagacaatctactattgtccaaatctgacgaggatactactgcatattggaaattggctaacgagctggttgataaatggagtcgaccaatattcaacaagagcacgagatttgaggacatgaagagatatgatgatgaaagagcaccttacaggcggtcacaaatgaagaaaccttcatcgagtagctc

SEQ ID NO: 78913 - DNA, 402 bp, Zea mays
  Clone ID: LIB3088-004-Q1-K1-H4
aattgaccgatcgactccacgcctcccatagaggacatttgcaagaacaatctaaagtaggaatgtgatcaccacgatatccgcactcgggtaaataattaccttggaccagtacatgacgaacgcatgcaatacataaatattcaagctgctgaccggaaattattaactgacactccaactgacttgcaacagaatgatcgaatacatcatctgatcaaaagtgctctattaaatgtcaatatggtatcgtccaaatatcaccatgagactactgacaataggaaattgagctaaagagctgcttgataaatggaatcgaccaatattgaacacgagcacgagattagctgacatgaatagatatgatgattaaagagcacattacatgatgacacaaat

SEQ ID NO: 78914 - DNA, 450 bp, Zea mays
  Clone ID: LIB3088-004-Q1-K1-H6
atagatgttctctccaagaagaatcttcagcaggaatttcttgaccacggagttctcactcgtctaaaaaattggcttgagccattacctgatggaagcatgccaaacatgaatattcgatctgctgtactgaaattattaactgattttccaattgacttggaacagtatgaccgaagagagcagcttaagaaaagtggtctgggaaaggtcattatgtttttgtccaaatctgacgaggagactactgcaaataggaaattggctaaggagctggttgataaatggagtcgaccaatattcaacaagagcacgagatttgaggacatgaagagatatgatgatgaaagagcaccttacaggcggtcacaaatgaagaaaccttcatcgagtagctctggaatggaatccagagatgatgatcttgatgctgacttttcacaacgcaag

SEQ ID NO: 78915 - DNA, 378 bp, Zea mays
  Clone ID: LIB3088-004-Q1-K1-H7
gaagaagaatgtgagatactcactaagatgcaaatttaagagtacaattctataagatgctggtcaaggaaaattccatagcctgttggtcaaacatacaatcgaacattctagtacgcctcttaactatgtctcaccaaattactgtgaatcagttcagttacgacaccgatatccgaagagagcagcttaagaaaagtggtctgggaaaggtcattatgtttttgtcacaaatctgacgaggagactactgcaaataggaaattggctaaggagctggttgaataatggagtcgaccaatattcaacaagagcacgagatttgaggacatgataagatatgatgatgaaagagcaccttacatgctgtcacaaatg

SEQ ID NO: 78916 - DNA, 228 bp, Zea mays
  Clone ID: LIB3088-004-Q1-K1-H8
ggaatgcacattgttagtttaaactggacatttctgtgtgctcctctgcgagtccttgtcggcgtgtaggttttagttgagctgtcaggttggagtgacccttctcctgtgtaacgcttgcctggtactgcttcagttatttggacactgtttgtgttgagttgttaacttcaagggtgcaaacctggataattatttagttattatatgactatctggtatccggtt

SEQ ID NO: 78917 - DNA, 469 bp, Zea mays
  Clone ID: LIB3088-004-Q1-K1-H9
tcgcccacgcgttcgggctcttggagatcacggtatcatatgcttggaagacgttgtgcacgggatcgccgctgttgggccgcacttccgagaagcatcgaggttcctcatgcccttcaggctcaagtgtccagagaggaggctgcagatgaagaggaaaccctacaaggatggctgctactcgggcgaccgtcgcgacaagatcaacgaactaatcgagaagctgaactagaagcgcaaaccttgcctactacagctgtcgctttgcgttggagcgatagatctgttattaccttgtcggttttgtaatagcatcagctgggtgtaccttcagctttgaaaccttacatgcgcttgtgcgatcaagtcatgaaatagcaggcgcttatttggtcatacccttgcgttctgcttcacatgcctcttagggaggtgcgacaatatatcagctggagtatgaatgatgtaa

SEQ ID NO: 78918 - DNA, 415 bp, Zea mays
  Clone ID: LIB3088-005-Q1-K1-A10
gcctttattcagtggctcaaggaagctgaagaggaggatgacgaagaagaggaataaccctggagttgagctggcactcgaattctttcatgcattgtgagcgcaggatctgatttgagtgggtctcccggtgagttcgcgagcagcaagttttgcaacctgtaattgcctgtacatcaacacaacacaattttgtccctaaccgcaactggtggagagtagcaaggagcgatttggcgtgaatgaaccaaaatgatcccagtgtagatgacatactataactgtgctatctttgcttggttgacgcttgggcgaagtcttcgccacatttgtttaactggccatcacctgtttcttggcaccaagccggcactcgcacagatctttaataaaagcttggttagatatggctccc

SEQ ID NO: 78919 - DNA, 260 bp, Zea mays
  Clone ID: LIB3088-005-Q1-K1-A11
gacccacgcgtccgaaaaaaaaaaaaaaaataaaaaaaaaaagttcaaaaaattaaaaaaaaaaaaaaaataaccatggaactgaccatataactcaggtcaaactatcgcacgcatacctccgaatcccattctcctatatcttgcaacctaacttcaatcaacttgccatgctaacccaatatcaactactcataaacccctcacaattcccaacttaatcgaatctcgctgaataccccatttaccaattttccctt

SEQ ID NO: 78920 - DNA, 338 bp, Zea mays
  Clone ID: LIB3088-004-Q1-K1-G5
cccacgcgtccgggccgccctttttttttttttttttttttttttttttctgtccacaacagggctttttgcagagattcagtacataaggattcttcaaattaaccataccacaccataacatgggacatttgcgaaactacgggtacaggtatcaaaatgcaacgagttcaatactaaaatataagcgtagtgcaatctaatcttctcagcaaatccccaattcctccgagttcgagcgaccatgtcggggcgtggcaagggcgggaagggtctgggcaaaggcggcgccaagcgtcaccgcaaggttctccgggacaacatccagggcatcacga

SEQ ID NO: 78921 - DNA, 441 bp, Zea mays
  Clone ID: LIB3088-004-Q1-K1-E9
gcgcccacgcgtccggggcaaaggatttgatcgtgcccggtgtgatgccatcagggtgctttgcggtctgcctgaccatgtacgctgaccgcaaggaagggcatggctcgcgcaccggctgcctcaagcggttcaacactttctcttgggtgcacaatgcgatgctgaagcgcgcgctcgtgaagctccgagcgaagcaccctggcgcgaggatcatctatggcgattacttcacgccaatcatccagttcatactccagcccaagaaattcgggttttacaaacaaccaccaagggcatgttgtggcgcgcctgggaggggtccttacaatttcaacctgacagcgaagtgcggtgagcctggtgcctcggcttgcgctgatcctaagacgcactggagctgggatggtattcacttgacagaagccgcgtatctgcaca

SEQ ID NO: 78922 - DNA, 71 bp, Zea mays
  Clone ID: LIB3088-004-Q1-K1-F1
cccacgcgtccgtggaaatgtagctcgttcatattgttgcattagcagctactatttgtgattccaggggt

SEQ ID NO: 78923 - DNA, 391 bp, Zea mays
  Clone ID: LIB3088-004-Q1-K1-F10
gcgcaagtgtgttcaaattgcacgactctatttataggatgatgatgcagtgaatgctgacggtgttatgaacaatgcttcatttttggtcaccaacagtcatcatgaggttctaaacttacagtacaaggtctgttatgcaaggattttggatctgaaaagaagatttctggaagctgcacttcgatattatgacatttctcaaattgaacaacgcaagattggagactaagagattgatgaaaatgcacttgagcaagctcttagtgctgctgtgacatgcacaatattggctggtgctggtccacaacgcttccgtgttcttgctactctgtacaaagatgaaaaatgctcgaaagtgaaaatattcccaatactgcaaaaagtttac

SEQ ID NO: 78924 - DNA, 258 bp, Zea mays
  Clone ID: LIB3088-004-Q1-K1-F11
gcgctcgtatagagaaggagaaatatcctcagtccctagctacggatctggatggcgtaccgtggcctcgtcttctacatgaccgtcggcggcgccccggcgggccggatcgcgatggagctgtacgccaacgaggtgcccaagaccgcggagaacttacgggcgctgtgcacgggctagaagggcgtgtgcaaatacgggaagccgctccactacaaggactgcacattacaccgtgtcatcccctagttcatgtgc

SEQ ID NO: 78925 - DNA, 455 bp, Zea mays
  Clone ID: LIB3088-004-Q1-K1-F12
gcggttacattccttggttacagtcagcaagatggcaaaaacatactagtgtatgagttcatgcataatgggacactaaaagagcaccttggtggagctgataatgaaaagataactagctggctgaagcgtctcgagattgcagaagattctgcgaaaggtatagagtatctccacacgggatgctccccaacaatcatccatagagacctgaagagcagtaacattctcctagacaagaacatgagagcaaaagtggcagactttgggctttcgaaacctgcagtggatgggtctcatgtgtcaagtatagttcgagggacagttggatacctggacccagagtactacatctcgcagcagctgacggagaagagcgacatctacagcttcggcgtgattttgctggagctcatctctgggcatgaacccatctcgaatgacaactttgggct

SEQ ID NO: 78926 - DNA, 315 bp, Zea mays
  Clone ID: LIB3088-004-Q1-K1-F2
gttcaaccgtgagcttgtgctagaagttttctttgcatgcaacaaggacgaagagcttacagccaactaccttctggatcatggccatgagtttgacgagcagcagcaatagacgtggggtggatggaggaaaccgaggcagttgcagaacagcgagtgtcgttcttatgctatgctgctgactatcttttatttccatatatatttgttcggaatgctttctaagtacatattaattcaatatcaagcgttacaccgtgtatgaaagcctgtcaaatcgtggcctttggtttggagggaaggattcgattgctc

SEQ ID NO: 78927 - DNA, 185 bp, Zea mays
  Clone ID: LIB3088-004-Q1-K1-F3
gttgcccatctgtgtttttgattgaaggtcgctctgtgtcagttgttagtgctgtgttcatgcgtcggcgccagcagacccatgcatcaaccagcatggactgcggatcgatgggtgctgttacccccgtcaggctttattctaagttaaatcctaaggaaaaaaatggtgcttcttggtgctgc

SEQ ID NO: 78928 - DNA, 386 bp, Zea mays
  Clone ID: LIB3088-004-Q1-K1-F4
cccacgcgtccggttcacggatcttcaaatatcacgaggagccattacctgaacacggaggagttcattgacgctgttgctgacgagctcagatcaaggctggcggccaactcgaacctttgaaatccttgccgaagttgtggtgctttcctgcgcgacgctttcgaaccgtttttattatgtcgccattttctttccctgtgccaccaccctgaatgaagaaggcctgagctaggcgaacatctgcaggccgcagcagtatgccaaatcattatcattaccgttgccattaccaattggagattgccgtagatttccgcgattatgggaactcatttacctgattatctgatacgtttgaaataaaaaggtcggcattcagaatg

SEQ ID NO: 78929 - DNA, 405 bp, Zea mays
  unsure at all n locations
  Clone ID: LIB3088-004-Q1-K1-F5
gatttggccaagaagtaccagtgcagcccagctcagctagctctagcctgggttctgcatcgaggggatgatgtggttcctataccagggacaacaaaaacgaagaacctagatgccaacgttgactccttgaaggtgaagctcacagctgaggacctgaaggaaattggcagccagatacgtgcagaagatgtggctggtggaagacaatacaattcctatgcacatacctcctggaagtatgcagatacaccaaaaaagtgaagctctggaaaccttgtagcaatcacaggcgtatgcaaatgttgaactatttccctgcatttgagccggaatcgtacgatgatgcatcttgtgaacatgcggcactaataaatcgagacgaagaataatgtantttccatc

SEQ ID NO: 78930 - DNA, 270 bp, Zea mays
  Clone ID: LIB3088-004-Q1-K1-F6
ctccacgcgtcgcgtatttgctcaagaagcaccagtgctaaccatgtgacatagccttaacacggatggggcattgggctcatgatctggctactataccatagacaacaaaagccaacaacctccattccaacgctgactccttgaatgttaatctcacacgtgacgacctcaaacaaattgtatgacagatacattcactttacgtggctcatcaaccacaatgcagatcgtatgcacatacctaacgatattatgcccatacaccaa

SEQ ID NO: 78931 - DNA, 377 bp, Zea mays
  Clone ID: LIB3088-004-Q1-K1-F7
cccacgcgtccgcggacgcgtgggtttacacgacctgtaatattttgcgagatggaccttagccatctcgcttcgcttacaggattagtctcacagatcatcactatccaaacagaactgagagcgattagcatttagtcaaactgtacaaatggtttcagagataccctgtttgggatagaagactctgatgtattgcaaacgatcttgaacgatcgatataatgggctctaatatgtcatatgtgacagaatcatgggccttcatagatgtgaaacgcccattcaatggaactgtttctatcagaggcagaattattgctgggacatgccacaatgctaagatgaacagaactatcattcgtcgcaggagctacc

SEQ ID NO: 78932 - DNA, 487 bp, Zea mays
  Clone ID: LIB3088-004-Q1-K1-F8
gcaaatttgacccagaactcaccacaaaacaggtccaaaggttacttttgctgtttaagccggttagtgcacctcaatctgttccaaataatcactttgaagaaaggcgtcactatgaagaacaaaggaagccatattatcattttgaagaaaggcttcctctgttgcctattgaagaagtgcgtcagccacggtttgatgatgaaaggcgccctgcagttagacatgttcctcttgaggatccatatagggcacaagcaccacgctttgcaccagttcctgttgagtctcagcttggccattcgttggctagtgctcagggtgatcacggcagatattatcaaccaccagcacttgcgcctgagcctcgacacattcctcttgttctagagcctcgctatgttccgtcagcccatgtgcctactgtgccagagcttcaacatgtcccagctgcatattatcgcacttcggctccatctggcgactc

SEQ ID NO: 78933 - DNA, 217 bp, Zea mays
  Clone ID: LIB3088-004-Q1-K1-F9
gattagtatatccaaagccaattctaaggttaaatttaaaggtcctactggtattaccggggaccgggtccttttggttccaccgggccttgcctttttcagacttggcctattttttaaggaggcattcccaaagtttaaactaacatacaaggttggccgccaacttcctaaaaaatacagcatggtcctaattccgtggaaccttccaaggaaa

SEQ ID NO: 78934 - DNA, 65 bp, Zea mays
  Clone ID: LIB3088-004-Q1-K1-G1
cccacgcgtccgcccacgcgtccgatccattaaatttatattgattgatatttttatagtggtat

SEQ ID NO: 78935 - DNA, 472 bp, Zea mays
  Clone ID: LIB3088-004-Q1-K1-G10
gcgcggacgcgtgggcggacgcgtgggctggaccacagatgagataaaagcactaaggacgaggtttcaggtgtcaaaaagagtccaaaatgaggaagttcccatggcagaggaagctctggcgatgatatcacaatcatttaggcaggtcgttcttgatgtgaaagttggacccccttcatttgagaaaggtttagctgaggatattttgtctcttctcaggagaacaaattgcaagaattgtcttgtctgggcaaaaagtgatgatataggaagagagataattaaattgtctaaagatgttattgttggctatgttgtcatggtggataaatttaccaatagaagaacggagttagtgaggattgaaagggctaaagttgctggcatatatcatcctttgatccatgagaaagttatgaaggtcatgcgcatgcatgacaagagagtttttgcatggacttgtgatgat

SEQ ID NO: 78936 - DNA, 109 bp, Zea mays
  Clone ID: LIB3088-004-Q1-K1-G12
tctgactcgtggtctgactcgtgttaaaaaaaaaaaataaaataaaatcactaaaaaaaaggataaaaggaaaatttaaaaataaaaaaaaaatcaaacactctatact

SEQ ID NO: 78937 - DNA, 400 bp, Zea mays
  Clone ID: LIB3088-004-Q1-K1-E7
cccacgcgtccggcgccacaacgctagcagctgcccgccattgacgctctttggtctccggggagctcgctgagccctgcctccacctcgccggggctctccctccacctcaccgagtcgtcgtcctttacagcagaaggaatggagggaacagagggaggatttcaagaaaaaggttaggcgcatcgtgcggaaatcacaggaaatgttctgaaggaaatgggagtgctggtgaagttaaccatgccatgtcaggctgcaggattttgctgccaacctcaaaagtgctcatctgacaccagcgtcttgtgtatcttccatttatcgtctgttcattggtgacaattgcctccagaaatgcattgggacgtggtcggcttggaaggttctgtttgtgtcg

SEQ ID NO: 78938 - DNA, 366 bp, Zea mays
  unsure at all n locations
  Clone ID: LIB3088-004-Q1-K1-G2
cggaaaaggatgatctctcattcacggatagcgacctggggtgcgacttctttccactcggtgcttgcgtatgagacctcttaacaacccctcgtgcagattggccctcgacgggatgggatgggactacggcctacgggagaggttgtaaagtacactgcttaggagcattggccagtttatgctgcctaatgtgttactatgcttggtactgtgcacactagaaatgctagggatacaggtagctacggacatgccttgtaatctacatttcctcctcttcgaatgggaaatgaaagtgattatggttaggtaaaaaggagcaagtataatgctccaaattaaaaaanaaaaanatattatatt

SEQ ID NO: 78939 - DNA, 377 bp, Zea mays
  Clone ID: LIB3088-004-Q1-K1-G4
gcggcaaaccctagccgacatatctcacgatccactcgagcaccaagccgagggaaggtgaagagcgatggggcgcggcgtggtgtcggcgaatggcggcacgcgtcgcgggcaagaagaaggggtcggattccttgacgatcgactgcacctagccagtggaggacatgatcatggaggtcgcctagctcgagaagtgcctgcaagagcgcatcactgtcgcctgcggctaagctggctacctcggtgactccgtcaccatctctcgcgagaagaccaatgtcaccgtcacctctgaccgacccttatcctagaggtacctgacgtactcgacccttaggtacttgtgtacacacaacgtgcgggattggcttctc

SEQ ID NO: 78940 - DNA, 398 bp, Zea mays
  Clone ID: LIB3088-039-Q1-K1-F2
accggaattgaagggccggccggagcgtcgcgtccgtctttcgtcttatcttgctcaacatctcttttgctctgatcttgggagtgccagtcggtgtgcgttgtggccaaggagaaggaaaaaacttcttggacagcatctgcctgcgccggtctgatgggcttgggttgcttcgggtgcttcgcgccggaggtggttgaggaccttaagcccttctagcccgactactcgttatgtgccgtttcgaggaggatggttctgccggatgttgccatctgctactcgcacattttcacctttttggacctgcttgtctcttaccgtcttcttttcctctcttatttggttggataatgttgtttcgtttagtttttcattgtcattttcatgttttttat

SEQ ID NO: 78941 - DNA, 65 bp, Zea mays
  Clone ID: LIB3088-039-Q1-K1-F3
acccactcatactctatattcttttccccaaaaacgctttcttttttaatcatctttacctaata

SEQ ID NO: 78942 - DNA, 383 bp, Zea mays
  Clone ID: LIB3088-039-Q1-K1-F5
ggtgccactgaaccagcacacctctcatctgatgcagacaagggcgcggagaattcaggccaggtgaacaccgccccccaagaaccgactgcagcaactgcgacaaggggcagatccaacctggtgcctctgctgtcaggtgcacataagggagcttggtctccgatgagagaccgttgctttgtgtgtttagggcaatacctcgcatttgctttgagaattataatcgtggttaacctgacaggacagcgctgtgcagcactaggctgcccagcacgtagttatctttccgttttttttatggcggcagggacaaatgcgtgtacccggttcaaagtgtaactcgtcattagcgtgctgaacattgatctctggagcggact

SEQ ID NO: 78943 - DNA, 386 bp, Zea mays
  Clone ID: LIB3088-039-Q1-K1-F6
cgagcaggaggtgaagaacttcttggagaatgcatacaacaatgcgaagaccattgttggaaaacacaacaaagagcggcatgctctagccaacgcacttcttgagcatgagaccctcacaggagcccagataaagaacatattagcccaagttcataacaaaccgcaacatgaacatactatcgaagcaccacagaaggcctcagtcgcaccagcttcccccgcatcaccagctgcatcagctgctgcagcagcagcagcagccgccgcggcagcacagcatgcggcagcaaaaagctaagggggtggctggtatgggatcttagcacattggagcactcccactggtttgcattgtgtatatttcaccaaacaagcaaagcttt

SEQ ID NO: 78944 - DNA, 411 bp, Zea mays
  Clone ID: LIB3088-039-Q1-K1-F8
cctctcctctcctcttgctcagtctctcgttggctctgttcttgggagtgccagtgggtgtgctttttggccaggagtaagggaaaaacttcttggacagcatcttcctgctccggtcttatgggcttggtttgcttcttttgcttctcgcctgaagttgtttttttttttaatccttttaattcatattacttttatatttcctaaacctatattaatttctaatttttttttatctaatatttattttttttttttttttttttactgtttttataattattttttttttccttaataattattgtgggtgttgttttttttacattattcatttccttctcatttctttatttataattttttatcgttttttaaaatttttttattatttttttatttttatttttt

SEQ ID NO: 78945 - DNA, 79 bp, Zea mays
  Clone ID: LIB3088-039-Q1-K1-F9
gtttttaattcccggtccgacccacttcttcctctatattcttatctccaataactccttcttttttttcttcttcacc

SEQ ID NO: 78946 - DNA, 410 bp, Zea mays
  Clone ID: LIB3088-039-Q1-K1-G10
aattctgctctttgactcaaggggcggatctattaaaccggaaaccgggactaatctcattgtgacattttttaggggatttcatcacatttaatcctattttataaactcaaatgtcatccgaaattctatttaacttatggaaaaataaaataatttctctttcaatcccctccaacttctgattatttaagttcctaaacttatccttattgaacttaaatccttttttttgaattgtaagtgtttatagaaaaatatatttacctgcttgtgatatatttttattttttttattttttttttttttttcttatttttttttttttcttattttatattttaaatcttacacttaatctcttttttattattttctttacttttatttaaatttttattttatattt

SEQ ID NO: 78947 - DNA, 222 bp, Zea mays
  Clone ID: LIB3088-039-Q1-K1-G12
accggtctctgattcccgtgtgcattttgagcacatgactattcgattagtggagtttttgaggtttaacctcggcagtgtcctggtttcagatgtcggaaatcaatatgcatgggagctaccatcctgtatcctctccaaatcagagagttcatggagattcatacagtaaattacaatggtgattccttccatttgttattttaatacttcaaccatttc

SEQ ID NO: 78948 - DNA, 252 bp, Zea mays
  Clone ID: LIB3088-039-Q1-K1-G3
gaaaactagaaaaggctcctcccgtctgcaacgcccctcatctccctctaccccgagaggcttacccgatggcgccgaaggcggagaagaagccagcggataataagccggcggccgaggagaaggcggagaagacgaccgcagggaagaagcccaaggcctagaagcggctgccctcgtccaattccttcggcaaggagggcggcttgaagaaggttaagaagattgccatgaagagcgtgtagacctaca

SEQ ID NO: 78949 - DNA, 361 bp, Zea mays
  unsure at all n locations
  Clone ID: LIB3088-039-Q1-K1-G4
gcattgtggatttcagagacggtatacgcttgtaaaaacaatcatcatcctctccgtctgtgaatgacgaaggtgaggcacgcgacntatcatgctataggctagcatccgtgctaatattttgtggcaccccttgatccattccaaagcgaactctgttgtgagttttctatcgttttgccactgcctacaactgttctgcgctttgccctttattattttttattattattcttattaatatatttgggctgccgtttctatgattatccattcttatcttactctttcatgctacctcttaggtggtggtgtagtgtcttctaaattttatttttctgtcccggtttttttataactt

SEQ ID NO: 78950 - DNA, 441 bp, Zea mays
  unsure at all n locations
  Clone ID: LIB3088-039-Q1-K1-G6
aagcgtcctaaaaaaaatatatcaattaattatataaaattatattttaaaaaaaaaaaaaaaaaaaaaaaagaaagtttaaattaaaaggctggcgggctaaaattcccnccctttcttcctcatactaccaacattcttatctctttcatttaactccaaattttttttctaccaccccatattttacaacttcttcccttttataactcatttctccccaaataaaccttctttttacctaaccatacttttctaacattttctataatatttttatatccctctccttatatctcttctaaactatttcctatatcttttattatattttttccccccctttttctacttattatatcccctttttttattcttttaactcctcttttttttccatttacttctcttttttaatttctaatattttatctttttttt

SEQ ID NO: 78951 - DNA, 53 bp, Zea mays
  Clone ID: LIB3088-039-Q1-K1-G7
ctcacgcttcaggacatctcctacttcatttcctttatatatcaccattaacc

SEQ ID NO: 78952 - DNA, 274 bp, Zea mays
  unsure at all n locations
  Clone ID: LIB3088-039-Q1-K1-H10
aatctctccacatgataacaactatgttgtttttcatgataggcttgttacaatcacagggacgtttgataaccaaatgagtgcagtanatttgatactgaaaaagttatctgaggatgttcactatccacctaatttgagctccccatttccttatgcaggccttacttttccaagctaccctggtgttcctgttggttatatgattccacatgtgccatatatttatgctgtgaactatggacctaataatggtttccgattgtaggtttta

SEQ ID NO: 78953 - DNA, 350 bp, Zea mays
  Clone ID: LIB3088-039-Q1-K1-H2
cccactcttccgcccactcgtccgatttgtttagctgaaagatggcttaaaaagggtgtgctcctaattaacagagagcgaagtccaggctctaatggaagcagctgatattgataacagcggaaccatcgactatggtgaattcatcgcatctactctgcacatgaataatctggagagggaggagaacttggtttcggcattctcattttttgacaaatactgatgtggctttataaccattgatgaactgtcacaagcatgtcatgaattctttcttgtaaactttcacctttaggatatgagtaatgaagtttaccagatctattattgctattatgatttacttt

SEQ ID NO: 78954 - DNA, 164 bp, Zea mays
  Clone ID: LIB3088-039-Q1-K1-H3
tcgctccatctcgtccttccactcgtcctgtctctttctgtccgcccatcgcgtccggtaaatgcgagggcgttacctgatactcgctggttaatgagatttgtggatttgggttgagacatatggtgatttgagataatctaagttctgtgggttcttgatcc

SEQ ID NO: 78955 - DNA, 358 bp, Zea mays
  Clone ID: LIB3088-039-Q1-K1-E8
ggtcatttggttacatccgtctctctgatttgcttagaaaaacatccaaagaaccgtctggggctcctccacgtgctgatgttgttaagagccttaaaaatggcatcgtggttaatattcttgggatgggcgctgctgttctcggcatgcatgctactgttgttgctttggtagcaaaagctctcacatcctctgcagtaccctattatcatgctgcttgccaaagccctgtcttggctttagatgttttcctagttcatgcttcatcgaacaccatcctgtctcatttcctttttgtggcgagcggggtggagcttcttctctcgttgtcactttctttatcaataatccatctttc

SEQ ID NO: 78956 - DNA, 87 bp, Zea mays
  Clone ID: LIB3088-039-Q1-K1-H5
acggttggaaattttactgaataatggaagatatcttaggttcaaaaaaaaaaaaaaagggaagggatatttaaaaaggggggaagg

SEQ ID NO: 78957 - DNA, 318 bp, Zea mays
  Clone ID: LIB3088-039-Q1-K1-H6
ctgatgtcaagaaagctattgcatgcttgttatttgggggatctaagaagaggctacctgatggtgtacgtttaagaggggacattcatgtcttgcttctcggtgatccctccacagcaaaatcacagttcctaaaatttgtagagaagactgcacctattgcagtatatacatctggcaaaagatcgtctgcagctggtcttacagcatctgtaactcgtgatagtagctcgcgtgagttttatttggaaggaggagccatggttttggctgatggtggagtagtttgtatcgatgaatttgacaagatgagacctg

SEQ ID NO: 78958 - DNA, 373 bp, Zea mays
  Clone ID: LIB3088-039-Q1-K1-H7
ctgacgcgttcgtttttttattcatacacattgtttatcaccaagatatccacattatgatgtgctaaccatcaagaaagatcgcaaggatccctgttaataaatcattaccgccagcaccaatacaccaagtaatacacggcgcatcacatcaactacaaacctttttattaccacgcttctcattcatgtaaaaaatgaaacggatgacatactttaatcaccactagctctgcttttttgagcgaaatcgagtatgtgagaagcacactcgctgtatacttatcatcatgatgcatatcttatggcaatgaactatgttattcactttttcttttattttaaatactacatctgcttatttaatatattt

SEQ ID NO: 78959 - DNA, 87 bp, Zea mays
  Clone ID: LIB3088-039-Q1-K1-H8
cttacgcctgcttttggttctgcattctactgaaaaagcgtacgatacacagcacattcagctgggaagaaaaaaaaggagggaagg

SEQ ID NO: 78960 - DNA, 353 bp, Zea mays
  Clone ID: LIB3088-039-Q1-K1-H9
cccactcgtcctcccactcgtccgcccactcttcctcttactcgtgttctacatgaccatgtatgattttaacgaacagactgaaaacatgaaacaaattcaggatgctttgtcagctcctcttggagcttttgctgatttcgacgaggatgaactgtaagctgaacttgaagaactggagggagcagagttggaatctcagcttcttgagcctgttgcagctccttcggttcatccagtgcatgtcccagccaacaagcaaccatctcgccctgctccacagaaagttacatcttaagattattaacttgcttcacttcaagctgaaatggctttgtgatcatgttctcatg

SEQ ID NO: 78961 - DNA, 447 bp, Zea mays
  Clone ID: LIB3088-039-Q1-K1-B2
ctgctgagcaggtagatgttgctattctctaggttggcctaggagggaagttcgagtcagctatttttgttgttagtgctggcgaatgtcctgttatctcaaaatacaaagcttcttttctcacctaatctcctaaaatggaaatgtttgactcattttttaattcttctttgaagctgattgtggacttatcctttctatgtagatatattctttcctttttatcattttctttttcttatttttttttaactaatttaataattttttttttcattttttatcatctattttttattatttattttatttgtgctttcatttttcttaatcttaaatatttaaatttctttatattttatcttattatatttctcttattttctattttattttatattctttatatattctctatttatttatcattaatttttttttattttt

SEQ ID NO: 78962 - DNA, 302 bp, Zea mays
  Clone ID: LIB3088-039-Q1-K1-C10
gtgctgtggtcggtgtccatcgccgtcacttcgttcggcggccaccggcggaccatcgcgtccggctgctccggcttgagcgatgcggtcgttggccgtcttcacgtacacccgacgcacagtgttcacggcgccgtcgtcggcgcggccgaagccgaacctggcggctcccagagctgccggccacgggcgcatcataatggatgcgagcgtggagtcctcgtgggtgcattgctggtacaggatcgcgcgctggtgcttctttctcatctccacgctcgtctgagggcggtcgtcttcca

SEQ ID NO: 78963 - DNA, 433 bp, Zea mays
  Clone ID: LIB3088-039-Q1-K1-C11
cccacgcgtccgctattcaccccccctctatgcttctatcactatccacttataaacttgagacggtaatcatgttcctagctagattcaaccatctaaggagccatggaatgatgtttgtttcctatcatatttttaaattagccacacaagtgaactaggttaagcactgaagctattctaatttctaactacagcactttgcttccttcttattttataaaattagagtatggtaagtgcagattcttagcaactctagttagggatggtattgggctctaggttttatactattaaagtttaaggataggattaggattgggctctatttctattcatttttgaactaaatattattaatgtgctaatcaaattgtgaagagattttgattatttccaccctcttagtctagttaatcttattttccta

SEQ ID NO: 78964 - DNA, 377 bp, Zea mays
  Clone ID: LIB3088-039-Q1-K1-C12
atttgacctatgttatggagtgagtgatatatgttccgtcactcctagtatatagtagtgagggactagttggtatgtgtagtactgcactatcttttctccatatgcatgttttgccagcgcgtaatgaatgtaatgtcagttcttaaattataaaaaattattattaaatttttttaaaataaaatttaaattttttattatattattttttttaatatttcttatatataaattttatataattctattatatttttttattttttaattatatattttatttttaattttctttcctttttttttgtggagtgttgtttttacattcttttcataaaataatatagtaatctttaatttttcatcatatattt

SEQ ID NO: 78965 - DNA, 269 bp, Zea mays
  unsure at all n locations
  Clone ID: LIB3088-039-Q1-K1-C2
tggccgacgcgcactcgtccgcggactcgtgggttactattagtcttctgttcccccacataccctcttgataccggatggaacatttttctgtaggggggcgcaaatntacaactagtatttctgctatcttgtacagattacagaattctccttgcttgcttgagttattggtgtaacatatctctgttaatttgacacatgatctgaccagcttgtgtatctttattttttccctttcctatctcttcatttcatatttttccttt

SEQ ID NO: 78966 - DNA, 276 bp, Zea mays
  Clone ID: LIB3088-039-Q1-K1-C6
aagcaagccatgtggaggagggctttagctatggtcctgttcatggctggcgccgggctgctctcctgggctggcggcgcgggctctcatcatggcttgtggagcatcatcaccctgcccatgttccagagcatgcttagccaccgtggcttacatgcgttttccatttcaccttctacacctactactccttcatctaggcctccagcatgttccctgtcttatgcaccactctttacaagcaaactctcatgtcttatctcaacttcttttttt

SEQ ID NO: 78967 - DNA, 164 bp, Zea mays
  unsure at all n locations
  Clone ID: LIB3088-039-Q1-K1-C7
ggatttccgancgaccaggcgtccttccactcttcctcccactcatacgcccactctttttttttatttttttccttataacaacgcgagagtgtattcttaacactttgaagagcaatctttttatctctatcatttctactacatatacatttacctcatat

SEQ ID NO: 78968 - DNA, 280 bp, Zea mays
  Clone ID: LIB3088-039-Q1-K1-D10
acgcgtccgcactcactacttataagcatatctcagtcttttatccacacaaaggtccctacaattcatgcaagggtcctacttaacggcgtgggtggctgcaccacatcacagattgcactgcagataaacttcttaaccataatactgctaggtaccatcgtatatcacaagcaaatctactcctgataggtacaagagcttatctaccattcctatagttcatgctttttatcctttactataacactgtactcatatataaactcctttatccata

SEQ ID NO: 78969 - DNA, 139 bp, Zea mays
  unsure at all n locations
  Clone ID: LIB3088-039-Q1-K1-D3
tcgtcctaaatcaccatcctaacgatgtgatggagtttggtttttcccccaagaccnaattccatcggtacgttttactcattcgttgagacatgtttctattttccctttttaataattcttattcatatatatacat

SEQ ID NO: 78970 - DNA, 378 bp, Zea mays
  Clone ID: LIB3088-039-Q1-K1-D5
cccacgcgtccgggccgccggcctctcactcccccgcgccggggccccgttcatggtgggccgcacctcctgtttctctgggtgggcagctatggtgccccgccgtcgactgctctctgggcctcccactgccggtgatcccccgcccccggcgctcccgccaacttcgaagctcgccgccccgccggttgtggggacgccggagcccccgctgccgtttagggccgtggaggcggagatccttcgagatattgaccccgtcgtcctgctcatcaaggatatcctccactccgatagatacggggatggcgaatgtctctgcccaagggacgaaaatgtcgtcgtggagaatgctctgttctaccattcacgctcgca

SEQ ID NO: 78971 - DNA, 291 bp, Zea mays
  Clone ID: LIB3088-039-Q1-K1-D6
tccttaacccattgatcgagactgatcatctttcctagacgccatgaacgtggaggaggaggtcgtttggctcaaggaggagatccatatgctcgtcctgcatcatccctatggctcttacaaggtcaagtttggcgtcctcttcaacgtctaccgttgtgcaaatatctttgaagcactatttgtcacctttagggccgtcttgaagagtatgatctttgacctactatggcgagcttcttctgcaagtgtttcatgtctacttttatataactctgttgcccctacctt

SEQ ID NO: 78972 - DNA, 144 bp, Zea mays
  Clone ID: LIB3088-039-Q1-K1-D7
tgattttttttacactttactggattttctttccctgaatcggaattggtctttgggggagctatttttacacctggtgagggcccattctaatatcctttcctataaatgcacataacattttaccaaatatccttaatagtc

SEQ ID NO: 78973 - DNA, 133 bp, Zea mays
  unsure at all n locations
  Clone ID: LIB3088-039-Q1-K1-D8
ttcccgtccgacgccactcaaactaaactacttcatacttaatggattttcatttcaagccnccaatacatctnnaaaacgacgatttattttataaaccttaccaccctaaacaactctccaccattttatc

SEQ ID NO: 78974 - DNA, 126 bp, Zea mays
  unsure at all n locations
  Clone ID: LIB3088-039-Q1-K1-E10
tttgtgatgtcgcatcttgtgcactcggctttgtataatattgngcttgcctgctatagggaccgctatcctgtattatgggatgggatatatactactactactactggtttattttcctttaat

SEQ ID NO: 78975 - DNA, 281 bp, Zea mays
  Clone ID: LIB3088-039-Q1-K1-E11
tctctcttcactcgtgagttattaaagtttttactttcagaaaaactcaacacctttttaagacagttctattgatataaacaaaaggcaaccctctttttatcaattattacaactattaaaaataacttacaaattattatttaattcaattcaaaatctaaataatattaattataatctaaatctaaaataattaaaatcatattataatttatatttatatcttaataaattaaattataaatattcatttaatatatatataaataatataatat

SEQ ID NO: 78976 - DNA, 295 bp, Zea mays
  Clone ID: LIB3088-039-Q1-K1-E3
caaaaacctttcctgagacgagtatccgctttcattcatgccagagcttatttctcagatgtcggttcaactttatggccagctctctgaagttccactcacaatttcacatagttgctgctactgcaaccgggacaaccttgattagtccgcctttggacactgattcctgcgtttaaccgacagataacgaagcataatgcggttatatagcgggcgctaatggtcactgagtagttagcatgcagatactaccctcctgtacagctttttaataaatatagtagcagtggta

SEQ ID NO: 78977 - DNA, 209 bp, Zea mays
  unsure at all n locations
  Clone ID: LIB3088-039-Q1-K1-E4
ccggcccgacccactcatcctcccactcttcctaaaaaaaaaaaatttactataaaaaaaaacaaaaaaaaaaaaaaggaaagatattttaaaaaagtaggaaagccccccccaacacncccaattccccctaatcttattactcccacctctttcttcccccttcctcctactttaatcctcttcttcacttcctccaaatctaattc

SEQ ID NO: 78978 - DNA, 395 bp, Zea mays
  Clone ID: LIB3088-039-Q1-K1-E5
cccacgcgtccgggtgaatcaaagttagttcttatcccaattgtcgtcgctgtagactgtgctttcccaccttcagacaaggttggcataaattccgtccaaagggaaaatgaggaaatagtgccaatgaaggcgatgaagatggcatgggtgccttatgttccccttgagaaccggctgagcaggattgacattttcaaaacaaatatattcacgctcggatgcacacagcgaatgtctgcactgaagcatctcaaaattgagagagtcaagaagtttgactactgcatgccttgtaagcttaatcgagtttgtgcataatattttatgacgcttcatctacattattagtaaaatggctgcaatggaactctttgtcaggttatttcattgga

SEQ ID NO: 78979 - DNA, 256 bp, Zea mays
  unsure at all n locations
  Clone ID: LIB3088-039-Q1-K1-E6
tctgaagatagaactattccattatttgttattgctgagcggactaagctttcaggcaagttcttttaatgtcttcttatgaanagcctctcggttcatcttatttagggaataattgatgaagtgtacagtacatttcacgtatcatgtgtccagcctatatttctttgaatttcacatgtttatgtctttttctaccgatttgattcctttgtttgtttagttctttccttattttttttttttctatctttat

SEQ ID NO: 78980 - DNA, 427 bp, Zea mays
  Clone ID: LIB3088-039-Q1-K1-B12
attaaaggtggtgcggatgctttctgttggcttctggtcctgggctgatagtttccactaggctggactgtgcatcccaagttggaagtgcctggctggtctcattctaatgcctggacctttcttgtcctgtaatcgtaggcacgtcttaatgttttttttaacatatcttttatctctgttctaactgtaatagtatttctatccatctacatttatagtctctcttattctcttttctatattttatcttttttctttcttatattttttatatattttttttttttatgtttggttgttatttatatttttttattacttttttttatttattcttattattttacttttttattctttactttttcttattctttatttctttttttttttttactttctttcttaatttacttatttttta

SEQ ID NO: 78981 - DNA, 161 bp, Zea mays
  Clone ID: LIB3088-039-Q1-K1-E7
attcccgtttggaccgcactcttctcttaaactatcttattccacctatttttcttttttcacggtcacattctcattatgggcaggttcatttatacacttggagggactttttctattttcttcatctatacttttttttatatctctacaaattttac

SEQ ID NO: 78982 - DNA, 399 bp, Zea mays
  Clone ID: LIB3088-038-Q1-K1-G9
cccacgcgtccggtgctgcacaggcaatgaggaggcctggaacagcccgaactggcggaggacccggtgcacaacgtgctcctccacgaagatgtcgaagacgagcggtttcctagtcggccaatagtccctgtcttaaaagcatagggacaaaaggccgtaaggagcacgttgttgcacgacgttgtcggcgtacagggtctagtggacctggtcatccttcaggtcgtcgagctcagcgacgaagctcaggtgttaccttcctcttggtctccttggccatgagacacttatggccgaagttggggaaaagaagtcccttgttgacgacgatgttggcggcgtcctcgtcggaggaatcggtggagctctcgtcggagtcccactctcacaacatgt

SEQ ID NO: 78983 - DNA, 382 bp, Zea mays
  Clone ID: LIB3088-038-Q1-K1-H1
ccccaagtgccccaaccccgttcgtcttccttcgtccgaccgtccctcgacagggccgaggcgcaacctaacagccgcccacacggcgcgacatccactggcgcaagcgcaatccgcaagggccaacggatcgccggccggcgcgccgccagcctcctggctcggccgccccgcggctaacccaggggcggaaaggccggtcagccgcccacaccccatccggccagccaggcggaaacgaccgtaagagggaagccgcatccggccgctgactccgatcccacctctagtcaaccccatgcagaccgatcctcctcgtctgaccacgacggccatctcgcacgcggcacgcctacttccactcaaccacacaagtcttttc

SEQ ID NO: 78984 - DNA, 333 bp, Zea mays
  unsure at all n locations
  Clone ID: LIB3088-038-Q1-K1-H10
cggatgcccgggccgaccgacgcgaacgtctggactttctttaccttgttccatttctatccaatggcgccgacctcgagggtgtctgcgggcattaaacgcgcttcacgctcncacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagcttatgtcgagcatcacgcctgggacggtgctgatccttctctcagggcgcttcatgggg

SEQ ID NO: 78985 - DNA, 350 bp, Zea mays
  Clone ID: LIB3088-038-Q1-K1-H11
gagataatagggtttgtggtgttttgaattcttttgtcaagcgaacatccaatggaaagcatgtgagttcattgccaccaaagcccttgaatagtgctgcagccgccgcgcagtctaagcctagtgttactccaaaggagcagtttgttactgctcggcggcaagatttgcctgtaagttcaaagcagggagcagacactaagtccgagaaggataatttcacagtattagataaggctggcaatggtcctgttgtcaaagaacaatcagttgatgcccatgcaagcaaaagtaagctcaaaatggaaaggccttgcctagtaatgggggatcgctggcttacatgtggg

SEQ ID NO: 78986 - DNA, 408 bp, Zea mays
  Clone ID: LIB3088-038-Q1-K1-H3
cctgatctttccttcccgtcttcctcccacacgtccccatcaccattgctgcgacgagagtgagcgggagagggtaggtggcgaggcggcggagatggggcgggggccggtgcagctgcgccggatcgagaacaagatcaaccgccaggtgaccttctccaagcgccggaacgggctgctgaagaaggcccacgagatctccgtgctctgcgacgcagaggtcgcgctcatcgtcttctccactaaggggaagctctacgagtactctagccattccagcatggaaggcattcttgagcgttaccagcgttactcatttgaagaaagggcagtacttaacccaagtattgaagaccaggcaaattggggagatgaatatgtccggttaaaatccaaacttgatgcact

SEQ ID NO: 78987 - DNA, 374 bp, Zea mays
  Clone ID: LIB3088-038-Q1-K1-H4
cttgagcggcgagggtggtgacgagaccaaagatatcctcctccttgatgtggctcccctgaccctgggtatcgagaccgtcggtggagtcatgaccaagttgatcccgaggaacactgtcatcccgaccaagaagtcgcaggtgttcaccacctaccaggaccagcagaccactgtctccatccaggtctttgagggtgagcgcagtatgaccaaggactgccgtcttctcggcaagttcgacctcaacggcattgcgccagctccaaggggcacaccccagatcgaggtgaccttcgaagtggacgccaacggtatcctgaacgtgaaagcggaggacaagggcacgggcaagtcggagaagatcacgatca

SEQ ID NO: 78988 - DNA, 225 bp, Zea mays
  Clone ID: LIB3088-038-Q1-K1-H6
gagaaatcagattggtggcaagcatacaaatgctccttgccgcgtaatatggccatggaaagaccatactactgcatgcagatgagcaggttgccggtgaagtcgtttgaccgcaaaccattcttgaactcaaagatgggacgggagctgtgcgtagccgatgtgaccgttggaggttcgatcaagctggtgctggctacaagccacctggagagcccatgccct

SEQ ID NO: 78989 - DNA, 250 bp, Zea mays
  Clone ID: LIB3088-038-Q1-K1-H7
cccacgcgtccggtgatgcacacgctatgttgaagcctctaacatgcccctctcacggaggaccctgtgcacaacttccatgtccacaaaaataaccaacacgagcagattgctaaccggtctataccacctctgttataaccctactgacacattgccgtcaagagcacgttgctgcacaacaatatcgatatgcaggctctcatagaccttgtcatacatcacgtattcctgctcaatgacgaagctc

SEQ ID NO: 78990 - DNA, 293 bp, Zea mays
  unsure at all n locations
  Clone ID: LIB3088-038-Q1-K1-H8
gcccacgcntccggngcttcacactcaatcttttatcctttatcaccccccactctncnaaggaccctagttcacatttttaaatgctccacaacacaaaccaccacnagcatattcctaaccgcccaatactacctctcttataaccatactcacacaatgccttcaagatcactttgctccacaacattatctacatacagtctctaaaagaccttgtcatccttcacatattcctcctcatcgacgaagctcaaatgttacctatctctccctctacttccacattatac

SEQ ID NO: 78991 - DNA, 471 bp, Zea mays
  Clone ID: LIB3088-039-Q1-K1-A1
ccgcactgttcatcatcgtcagtatgaattgtctattgccttcaaagctttctttcttggtcagctttacattgaagaaatgttctgctcaacctcacaattatatactatacataactcatatattatcttgttcaacttgcactatatttcatttgagtacttaccttttattgatctctctttaatctaaactagtgttcaagttaaaatatttatattatataattaattaaatttttattttttatattttattatatttactctttcttttcttatttttccaattattacctttcttaattttattttgtttatttttctttcttaatcttttatccaatttttttatttatttttttattttatttaaatattttttattcttttatcttaattctaaatttacaatttttattttttctctatcttatctttactttcttatatttttcttttatttatctt

SEQ ID NO: 78992 - DNA, 226 bp, Zea mays
  Clone ID: LIB3088-039-Q1-K1-A11
tcttactctttttcttactcgtatacgaggttctgctttatggacccgtccttccatctgggggcggcttctatgatgctagggccagttctttatctgcactgtgtcctccatccttgtgtcacaacattttacatcgttcctaataatatcactccttcatgtttctatttttcaaaaattcttattctaataatttatgtcttaattattggtttctttttca

SEQ ID NO: 78993 - DNA, 162 bp, Zea mays
  unsure at all n locations
  Clone ID: LIB3088-039-Q1-K1-A3
actcgttcgggcttcttcttccccaccggttcgttttctttttctggttcgtggcccaaaaggaaggaggtgtcttctttctgacgttgagtaccnctgcttcnttttcggcctctcctgtgccaccgactaccactccctttacaactccttcagcaccta

SEQ ID NO: 78994 - DNA, 336 bp, Zea mays
  Clone ID: LIB3088-039-Q1-K1-A5
gagcgaaacaaacagcgcctcctcctccttctcgcatgctcctcctccaccatccgaaccgcgtatgttctggcaggggcatcggttcctcaacttcctcctcgcctgcatggtgttcgccttcgtcatctcttggctcttccacttcaacgtccccggctaacatgttctttggcgcacatacatggcccccgaataaaaaaaaactccaaaaaagccattactccggacgccgggtcggtaagttagcggatctggaagaacaggctggtgggtgctgggttggttgaagtaaaagctcgacatggggccggttgacttttatactgtcatttt

SEQ ID NO: 78995 - DNA, 59 bp, Zea mays
  Clone ID: LIB3088-039-Q1-K1-A6
gtttttaattcccggtccgacccacacatcctacccttccatcatctaactctcccttc

SEQ ID NO: 78996 - DNA, 357 bp, Zea mays
  Clone ID: LIB3088-039-Q1-K1-A7
cgcccacaccaaataaccaccggcctatgtcttggaggagccttgcgagcatactgggctgcttgaatactacctgcgcaccatccctttcgatgacggcacggcgctgaacggcatgggtctggtcggcgaagagccggccggtttctcgtcacctgtttacaggtccatcactgaaagcaagagtgacaagaggagcgaggagcctactactctgcatagcttcaaccccgtgactggctcatcagaggtcggctcacctgacgagcatagcgagcctgctcccaggtctgggtccgggtctgggtcaggcccgcatgaatcgttgtggaagaaacagcttctctccctttacag

SEQ ID NO: 78997 - DNA, 478 bp, Zea mays
  Clone ID: LIB3088-039-Q1-K1-A9
atccccattctcttacgatgatcaatctttttcgttctcaaaatctctcgaccagaatgcggatagtttatctcatgggctcgccagccatcatgaactactggagagaatgtcttgtaaccgtcttatctgatgatgttttcattacttctctgtttaatctttatattaactttttttttttttataaatattattaattatatattttttttatttcttatttttaatttctttttcttatttttgttttatatttttttaaacttaattttttttatatattttatttaatattttctctatttatttaatatgttggttttaatttaatttattttatttttttattttatttctattataaattatattattttttttatctctcattttttatttataatatttataattttttttttttatttttattttaatatatatattattatatattattattttttatattttt

SEQ ID NO: 78998 - DNA, 428 bp, Zea mays
  Clone ID: LIB3088-039-Q1-K1-B1
cccactcgtccggggagccaacaattcttctgctttgttgccttggcctttggatgaagggtctatatcatggtgtatcaacttaagcagtgacaatcttctaaagaatgtcgaagaggactacttcacagctctgcaaagttcacctgccccagtataatgaagaaactgataaatatctaaaagggaacatgcaaatcaaggtgtaaatcttaacagtgccagaaatctggcagttttgggtgaggagattctacctgccatttttcggtttgtacatatgagcctgtaacatttgtggttttttttatatgggccaggatagaacttctccattgtttgttcaaggcaagcataattatcgcctgcatgttgtattttgtataaatgttcatcctttaactaaaactcataaatgaagattgatt

SEQ ID NO: 78999 - DNA, 326 bp, Zea mays
  Clone ID: LIB3088-039-Q1-K1-B11
tcccacgcgtccgcgaagaacttgtgcagtatgcatttagctagctagctgccattgttgcgagagtagctaagctaggctgaggcgacgtgggaagattcgctcgctggtccggctcatctggagagcgaccgccatcatgctcatgccggccagctcgtggctcttaaagttttttaaatcatgtctctaagttcgtggactgcatttcacactttgttttgcccgcaagttgttgattaattcgccgaggccaccaatggcaggtgcccatgttgctagttaaaaaaaaaaataaggtctgccgcgctgatggatccaagctt

SEQ ID NO: 79000 - DNA, 347 bp, Zea mays
  Clone ID: LIB3088-038-Q1-K1-G8
cgcgggcgcccaggcgtccgcccactcgtccggtggccttcaactctcaaggatgaccctgccaaggaagctgctaggttcactttccaagtcatcatcatgaaccaccctgggcagattggcaacggctatgccccagtgctggactgccacacctcgcacattgctgtcaagtttgcggagctcattaccaagattgataggcggtctggcaaagagcttgagaaagagcccaaattcctcaaaaatggtgatgctggtatggtgaagatggtttccactaatcccatggtagtggagaccttttctgaatatcctcctcttggtcgctttgctgtccgtgacat

SEQ ID NO: 79001 - DNA, 353 bp, Zea mays
  Clone ID: LIB3088-004-Q1-K1-D4
ctcatcttttcgcgtttagaacctctaaaatttcccccactcgccagtcgcagcagcacctgtggccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacatgaagacgcgcatcatcccgcgccacgtgc

SEQ ID NO: 79002 - DNA, 453 bp, Zea mays
  Clone ID: LIB3088-004-Q1-K1-D5
gaggaagacacggtcacctaagctcgcaatcgatgcaaatgtaaatgaagatgagggtagccaatattcaaattggttggcacacatgggaagtgtggcagtcaaccaacagtcaaatactgttggtaataatggtgccccgtcatcatctgaagtgcgctcccatatatctaaattagcttccatcgactcctttgactcaaaatggcaagaattcctggaccccggcgagtctgtagtcttaatatcaaagctgaagaagattaataagctatcaaacaagaagatccagttgatcctcactgacaaacctcaattgatctgtgttgacccttcaaaaatggtggccaatggaaacattatttggtctgatgactcaagtgaactcagtgtgcacgtatcagattcttcacattatagaatatgcacgccaaagaaggtgttaacatttga

SEQ ID NO: 79003 - DNA, 442 bp, Zea mays
  Clone ID: LIB3088-004-Q1-K1-D6
cccacgcgtccgcccacgcgtccgcggacgcgtgggcacgcccaaaaattccgagggtttcggctcttggagcgcaccaacaccacccggagaccggagcgactcgccaccggcgcggaaaaggagggcggaggctcgatggcggatgagaatcaggctggaaagaaagaggaggaggaatttagcacaggccctctgtcagtcctaatgatgagtgttaagaacaacacccaggtcctcatcaattgtcgcaacaacaagaagctgcttggccgtgttcgtgcttttgatcgccactgtaacatggtgctcgagaacgtgcgtgagatgtggacagagatccccaagactggcaagggcaaaaagaatgctctgcctgtgaacaatgatagattcatcaagtagatgttcctcaagggcgactcggtcatcatagtgttga

SEQ ID NO: 79004 - DNA, 87 bp, Zea mays
  Clone ID: LIB3088-004-Q1-K1-D7
cggacgcgtgggcggacgcgtgggcagctagttgcttcgtcgttgtaacttgggtgtctacgtatatattatatgtaccagcggttc

SEQ ID NO: 79005 - DNA, 461 bp, Zea mays
  unsure at all n locations
  Clone ID: LIB3088-004-Q1-K1-D8
tcgcattttccttgcaaccgattgcctatccccctcccaaccaaagaccgatggcgcccaaggccgagaagaagcccgcggcgaagaagccggtggaggaggagcccgcggccgagaagacgaccgccgggaagaagcccaaggcggagaagcgggtccccgctggcaagtccgccggcaaggagggcggcgagggcaagcgtggcaagaagaagggcaagaagagcgtggagacgtacaagatctacatcttcaaggtgctgaagcaggtgcacccggacatcggcatctcctccaaggccatgtccatcatgaactccttcatcaacgacatcttcgagaagctggccggcgaggccgncaagctcgcgcgctacaacaagaagcccaccatcaccttccgcgagatccagaccttcgtgcgcctcgtgctccccggcgagctcgccaagcacgccgtc

SEQ ID NO: 79006 - DNA, 370 bp, Zea mays
  Clone ID: LIB3088-004-Q1-K1-D9
tgcccttcacggaagatggttcgctgggaagatgatttcagcgacatttatgtccgctcgggagtggagtacgaagttccgaaacttgtgagcatatgccgggaagagttggccagacctgcatagttcgtttggagtattctcaagtgctgtatcgttggatggtagacgaacaccttattgattgtatgacaggatagttgcagcaccgggcgtcactatcagtacaatgcttgatgtactttatttactgcgtcgcagtgaccaaaccttatttttgtccaccgaatgaaatgccctatcatctccaaaaaacaaaaaagtattatcccaacaatatgcaatgtaaatttaaaaaaaaaagggcggc

SEQ ID NO: 79007 - DNA, 352 bp, Zea mays
  Clone ID: LIB3088-004-Q1-K1-E1
gcatcgcgcattatcgatgccaacgctgtgtgaagtgagaaagggctaattctagacccaagactttggtctaacggatcatgtctttgtaactgaatcatttgatgcaacaggcagcagctgccgacactgctcgtggcggtgtacgtcctggtggtgggcgcagcagcagtgtgcgacatgagcaacgagcagttcatgtcgtgccagcccgcggcggccaagacgacggacccgacggccgcgccgtcgcaagcatgctgcgacgctctggcggtggcggacctcaagtgcctgtgcggctacaagaactcgccgtggatgggcgtctacaacatctaccccaagcgcg

SEQ ID NO: 79008 - DNA, 445 bp, Zea mays
  unsure at all n locations
  Clone ID: LIB3088-004-Q1-K1-E10
gcgcgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaagcccaaggcggagaagcggctacctgcgggcaagtccgccggcaaggagggcggcgacaagaagggtaggaagaaggcgaagaagagcgtggagacctacaagatctacatcttcaaggtcctgaagcaggtgcaccccgacatcggcatctnctccaaggccatgtccatcatgaactccttcatcaacgacatctttcagaagctcgccgcggaggccgtcaagcttcgcccgtacaacatgaagcccaccatcaccttccgcgagat

SEQ ID NO: 79009 - DNA, 360 bp, Zea mays
  unsure at all n locations
  Clone ID: LIB3088-004-Q1-K1-E11
gcgctccaagcacggatcttctcgtcgtctccttcaagcacggatcacgagcactgaaattctgtctcagcctgttctgccgactgggtagcttgaattctaaaggttgatccaagcangaggtgaatgtgtgatcgatggttattttgcatttcttctatgttgatgcatgaccgttcatggagaacgctggtagttgtgatagctatcacacactcttttggttaataattagatactctttttgttgatcaatgtgaacctttaatggtgtttataggtcttgtcgagtttttaatgcgctattatgaaaatgctatgtgctgctattgatgattggacatgttaatggctctatat

SEQ ID NO: 79010 - DNA, 390 bp, Zea mays
  Clone ID: LIB3088-004-Q1-K1-E12
gataatttatggagtgcatgacgaagcgaaggacaaagcttttgagttggagttgagctggatctgggatgaatcgaaccgtcagcatcagaaggttccaaatgaactgttggagcaggccaaagctgctgctcaggcagctcttgaggagatggatgctgactaagaaacaggacgatttgcccagacttggtgtttttggtgctgttgaaatctccgatccctttggggtgacccactggacatggccaatttgtcacaatttattattttgacccatgtcatgtgaaactcctttcgttgaagtctggtatctagattgacttgtatcaaagcttgggtttacgcagactggattctggagtactggactgggtgtggtgttttcgg

SEQ ID NO: 79011 - DNA, 447 bp, Zea mays
  unsure at all n locations
  Clone ID: LIB3088-004-Q1-K1-E2
atctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcaccttgtatgttctgagattcatgataatgctatgagaacttgaaattcccgttaaaaaaaaaaaaanaaaaaaaaataatataatatattt

SEQ ID NO: 79012 - DNA, 399 bp, Zea mays
  Clone ID: LIB3088-004-Q1-K1-E3
cggacgcgtgggcggacgcgtgggccgcaagacactcaaatctgatggtattgctgggcttgaccgtggatttaacatatcttgtgttggaattattgtttatcgtggcctgtatttcggactttacgattctatcaagccagttgtcctcactggcagcctccaggacaacttctttgccagttttgctctgggttggctgatcaccaacggtgctggtcttgcatcttaccccattgatactgtccgcagaaggatgatgatgacttctggtgaggctgtcaagtacaagagctccttggacgcattccagcagatccttaagaaggaaagccccaagtccctgttcaagggtgctggtgctaacattcttcgtgccattgctggcgcttgtgtgct

SEQ ID NO: 79013 - DNA, 390 bp, Zea mays
  Clone ID: LIB3088-004-Q1-K1-E4
ccagtgtatgtgcatcgagatatcaagtctgcaaatatcctgatagacagagacttacgaggaaaggttgcagattttggactgacaaaactttcagaaattggaactacatcacagtcactcccatcactacgagttgttggtacatttggttacatgcctccagagtatgctcgatatggtgaggtttctcctaaggtggatgtctacgcttttggtatagtcctgtatgaacttctttctgccaaagaagctattgtgagatcaacagaattcactgatgcacaaggcctggtttatctgtttgaggagactctcagcatgccaaaccccatggaagctctttaggaaatgattgatccaaagctaggaggtgactaccccattgac

SEQ ID NO: 79014 - DNA, 324 bp, Zea mays
  Clone ID: LIB3088-004-Q1-K1-E5
gcgtcgacgcatgcgctgacgcgtactccgcaagacactctaatctgacggcattgctagactgtgccgtggattcaacatatcttgtgttggaattattgtacatcgtggcctgtatttcggactttacgattctatcaagccagttctcctcactggcagcctccatgacaacttctttgccagttttgctctgggctggctgatcaccaacggtgctggtcttgcatcttaccccattgatactgtccgcagaaggatgatgatgacttctggtgaggctgtcaagtacaagagctccttggacgcattccagcagatcct

SEQ ID NO: 79015 - DNA, 416 bp, Zea mays
  unsure at all n locations
  Clone ID: LIB3088-004-Q1-K1-D12
cccacgcgttcgcggacgcgtgggcgcgaccctggggacgccgtccaggacgccgtgctggacgctgatccaggggctggcggacctggaggcggcggtgtgcctctgcaccgtcctcagggccaacgtcctgggcatcaacctcaacctgcccatcaacctcagcctcctcgtcaactactgcggcaggcgcgtcccctcgggcttccagtgcttctgatcacgcccatcgatccatctgcaggctaaataatttgtccaagctagtatatatacgtacgtacgttgatatatatgatgtagtattatatatatgtccatgcatgcaatgcatctcgtcgtccatcgcatgttgntgtcgttggtgtgtgtgttttcgatgatcctgtctctgttataaatatcattattattac

SEQ ID NO: 79016 - DNA, 202 bp, Zea mays
  Clone ID: LIB3088-004-Q1-K1-B4
aaaaaaaaaaaaaaaaaaaaaaaaaaaaaaattaaaaattaaataataaaaaaaaaaaacaagggatatagaaatatccaaacttaagaacacaaacatacggcctgactattttgatgttccatcctcttcaacccaatctttcgaccttatagctccaatttcgtgactcgtaaatccatttcattacccatctttttac

SEQ ID NO: 79017 - DNA, 452 bp, Zea mays
  unsure at all n locations
  Clone ID: LIB3088-004-Q1-K1-B5
gaaaatcgtccaggagatgactaggatgaaggatgagaggaacagactgaggatgatcatggcgcagtacatggcggaggacctggcatcgttctccgcgcaggatctgagcaaccttgagcagcaaatcgagttctcgctgtacaaagttcgcctcaggaagcaagagctactcgaccagcagctgctcgagatccaccaaagggagatgcatatgccagcagagcagggcggctacctgtgcctcatgaacccggctgcggctattgctagcgggcagcaccagcaggctggcgagatggtgggaattaacccgaggccgttcccgtggtgggacgtgggagccagtggcagtggcagtggcagccagagccagcagcagctgctgcacggccgggacgccgcggagtcgtcgatgacggcgctcgggctgtcgncgcaactgcatgggt

SEQ ID NO: 79018 - DNA, 308 bp, Zea mays
  Clone ID: LIB3088-004-Q1-K1-B6
cccacgcgtccgcccactcattctcatacacgttgacagacacatacttacactcatcatggagcactacatgtcggaggacctaacatcattcatatcacatgatctgagataatttaatcagacaatcaagtcttctatgttcataattcgcctcataaaacatgagctactctactagtacttgatgcaaatccactcaaaatagatgcatattccatcagatcagcatggttacctgttcctgatcaactcggatgcttctattgctaacgagcattaccacaatgttcactatattattgtaa

SEQ ID NO: 79019 - DNA, 462 bp, Zea mays
  unsure at all n locations
  Clone ID: LIB3088-004-Q1-K1-B7
cccacgcgtccgcgaggcgacgccgaggcacctcatctccggcgaagggaaatggcgaccggtccaggggatctgatctggcagattgtgaggaagaacaactccttcctggtgaagcagtttggcaacggcaatgccaaggtgcagttcaccaaggagcccaacaacctctacaatttacactcctacaagtactctggcttagcaaacaagaaaactgtaacgatccagccagctgctggaaaggactcggctgtggtcctctctactaccaagaccaagaagcagaacacacccgcgaagctcagccacaagtctgtgatgcgcaaggagttccgcaagatggccaaggctgtgaaaaaccaggttggcgacaactattacaggcctgatctgaccaagtcggcccttggtaggctgagctctgtgtaccgcagcctncaggttgccaagtctggtgtc

SEQ ID NO: 79020 - DNA, 484 bp, Zea mays
  unsure at all n locations
  Clone ID: LIB3088-004-Q1-K1-B8
gtccaggtcccgactgccgctcccgtcgaggaggctgctgctgctgctgcagcgggagtggaggctgcccagctggccgccgtcgagaccccgaacgaggagaccgctgctccggcggcggagaccgaggtcgtcgccgctaaggagccggtgtcggccgaggccgagactgagtccaaggaggtcgaggtcgaggccgaggccgtagctgaggctgagccgaccgaggcagagcccaaggaagcagagcccgaggccgccgcgccggcagcagagacggaggctgctgctgccccggtcgaggctgctgagccggagatagccgccgagaccaaggaggcggcggctgtggaggctaacgaggaggagggggaggcatcgcctgcggttgctgccactcctgaggtcgcagcgaccgangaggaagcggccgtccctgcttccgaggccgncgtcgctgccgtcgagaagtccgtcgagtgag

SEQ ID NO: 79021 - DNA, 381 bp, Zea mays
  Clone ID: LIB3088-004-Q1-K1-B9
acccactcgtcctaaaaaaaaatacaatcactaactaattaaattaaaaaaaaaaaaaataataaatatattaaggtattacgtactatatccgtaaataaaaaataaaaactaaacaaatataaaataaaccaaaaataaccttacttaacaaaacactataaaaaaaatccctccttttaaaacttccatacttaattcctattctttccaaactttccctctttattttattcccccaatttaaaattatttacccctattttaaaaatgctactcctttaaaaccttttccttccccaaattaatacccttttaaacaaacccctttttaccactttcctttattataaaaattccccctcctaaccccttttaaaa

SEQ ID NO: 79022 - DNA, 250 bp, Zea mays
  Clone ID: LIB3088-004-Q1-K1-C1
ggtttagtgggacatagtcgtcggtatcttacagcatgtgtttctgatggagtgatatggttagtaagcagtggtgaaggatacaggcatacgggcactggggcatataccatacttttggactagacgggctagagactgattttggagtccgttatgtttccattttccgttctcttggttttctctgtcgtcaatgtattataatcatgatgatgaatggatggagaaatgagatgagatttttttg

SEQ ID NO: 79023 - DNA, 452 bp, Zea mays
  Clone ID: LIB3088-004-Q1-K1-C12
cgcacgcctgcctccactctacagctgagccgcctcgtctctctgctatctgctgcgcccgcctatggtgcatgattctatccagcagtctacggttcgctcgcctggcttcgcgatggacaagggcagtgtctacttgcccctctcccgtgtctgcgactgcgcgaagaatgccaatcgctctgagatcaagaagtggcacgccgtctctctctgggcctgggacatcgtggtggacaactgcgccatctgccgtaaccacatcatggacctctgcatcgagtgccaagcgaaccaggctagcgccaccagccaggagtgccccgtctcttggggaatttgcaaccatgcattccactttcactgtatcaaccgttggcttaagacccgtcaagtgtgccctcttgacaacagggaatggcgagttcaagaatatggtcactagagagaat

SEQ ID NO: 79024 - DNA, 54 bp, Zea mays
  Clone ID: LIB3088-004-Q1-K1-C2
cccacgcgtccgtggaaaaccctcgttttcattgataatggcaagatagggctt

SEQ ID NO: 79025 - DNA, 352 bp, Zea mays
  Clone ID: LIB3088-004-Q1-K1-C4
cggacgcgtgggcgaccaggtacatatacaaacctgacctcccctgcgtttatttagtgattcaaacttcaaaacttttatcctaagttactaaccatatgcactgtttatgtcatttacagggaaaagcgcaaggttttattgcaaccgtgcagtctgtagctatattgttggcaccactatttatgagtccactgacctcttacttcatttcagaggaaacgcccttcgactgcaaaggtttcagctttattgtggcgagtttcttcttggcaatctcgttctgcctcgcttggatgcttaacccaggaatgaaggacaagggcacaaaagctgtcgtttcagacagcgc

SEQ ID NO: 79026 - DNA, 77 bp, Zea mays
  Clone ID: LIB3088-004-Q1-K1-C5
aaaaaaaaaaataaaaaaaaaaaataaaaattaaaaaaaaaataaaaaataaaaaaaaaaatgggaataaatacaaa

SEQ ID NO: 79027 - DNA, 190 bp, Zea mays
  Clone ID: LIB3088-004-Q1-K1-C6
gaactgcactgtctatgttttgtgctattatggttgtttaatggcccaatcattgcatatagattctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggtagaccttattaa

SEQ ID NO: 79028 - DNA, 477 bp, Zea mays
  Clone ID: LIB3088-004-Q1-K1-C8
agatgacggaccaaaaagaagcatactttacatagagaccgccgaccggcctggcgtacttgttgagataatcaagatcatcgcggacacaaatattgatgtggaatcagctgagattgatactgaaggtttggttgcgaaggacaagtttcatgtaagttacagaggtggaaaactaaacagctccttatctcaggcgctgaccaattgcctgcgttattacctccgaaggcctgagacagatgaagacagctattgattgttgtgtttgtcgaaccttcctatagtgcattagaatcagaaactttggcttcagttccttcgctatgggccccttgtactgctgcaaatggagttttccattgtagctgataaagtgccgacaaggtgcatccatatgtgcataggtggcactgaatcggggctcactggaccagtttgatattgtagtaatatatatacagctgggagcaacat

SEQ ID NO: 79029 - DNA, 378 bp, Zea mays
  Clone ID: LIB3088-004-Q1-K1-C9
gcggattcaaagactacaaaattctacccgtcaatcgggacctatcaatcattcaatcaagtctgtccctgggatctttttgaaccaaaaacgtccttataaaactggaaaccctgaaagggtttaatagtatattaatgattttttaattggaatggtccactgaattctttaataatttgtaatgccaacctaattaattgggttttttggttaatggggcctaatatggcccattccccataatgaataaaatgtaacttgccctaattttggggtaaatgtgtgttggtaaattagtcattaggcaactttttaatgctgggattcattagaacaccatggaaccttataattggttgggtaatggcaccaagg

SEQ ID NO: 79030 - DNA, 253 bp, Zea mays
  Clone ID: LIB3088-004-Q1-K1-D1
cccacgcgtccgcgccaacatggccaccggcgacgcgtccgccgcgggcgccccgctggtggcttcggctcggttcgtggtggcgacattgctctgcggcctccatttgcggcggcttctgctgtagtggtgatggagagggtagaggaaacccactcgtacgtagtagcactgtactgtaccttaccttacattgtagcagtgtctgtagatgattactatcaattgatgatgttgagttagtcgcaggatt

SEQ ID NO: 79031 - DNA, 313 bp, Zea mays
  Clone ID: LIB3088-004-Q1-K1-B3
gcgcaaggagctcgacggccgtaacatcaccgttaaccaggcccagtcccgtggcggtggcggtggctgcggtggctacggcggcggtcgcggcggctgcggctatggtggcgggcgccgtgacggcggttatggcggcggtggcggctacggcggtcggcgcgagggtggtggcggcggctacggaggcggtggctgctacggcggtcggcgcgagggtggtggtggcggctacggcggctgcggcggctgctggaaggactgatgtgtgggcccatcctggcttcggtcgagttatcttatctatctatag

SEQ ID NO: 79032 - DNA, 432 bp, Zea mays
  unsure at all n locations
  Clone ID: LIB3088-004-Q1-K1-D10
gcgctacaatactttgatggccggccaatgtctgggacagttcctcaacgagtgacttgcactgttgttgaagcacaaccaaatacaaaagggctaactgctcaaccacagtataaaagggtcttgctggataatggtcttacagtgcttgcaccaccttttattgaagcgggtgagaatattgtaatcagtacagccgatgattcttatatgacgagagcgtaaggggtatcgtggatgacgttttgttctaccaaatggggatcgattacaatgtggctaccagaataattttatttacactcagttgtggagttgccgtaaacagtgaaccttggcggacaccaaccaaaaacttttagttcttagctaataacccacacattttgtactcacatgtctnttcggtttgttcctcgcttcaaatattta

SEQ ID NO: 79033 - DNA, 214 bp, Zea mays
  Clone ID: LIB3088-004-Q1-K1-D11
tactcatcgatagactctcactgatatggaatcacatccaactgcattagggctaactactcaaccacagtataaaatggtctctctctacaattatcatacaatgctttcaccaccttttattgaatcatcttataatattgtaatcattacatacgattattcttatatcactacaacttaattcttatcccctatgacgacttattctacc

SEQ ID NO: 79034 - DNA, 207 bp, Zea mays
  unsure at all n locations
  Clone ID: LIB3088-003-Q1-K1-H8
ctctacattatataaactntgattagccggaacgattccgggtgcaatccgacgcatacgaacaagccctaactgagattaatgtgtccttgctgtaatgtttagccagtcctgccccgatccggggaactgagagattgtctttatcgcaacattaacggctagcggttagtatcatcttccagtcaccttgaatgttactagtac

SEQ ID NO: 79035 - DNA, 321 bp, Zea mays
  Clone ID: LIB3088-003-Q1-K1-H9
aagataaggactgtcgagttggatggcaaacggattaagttgcagatctgggacactgggggccaagaacgtttccgcacgattactactgcttactacaggggagcaatgggcatcttgcttgtgtacgatgtcacagacgagtcatctttcaataacataagaaattggatcagaaacattgagcaacatgcttcggataacgtgaacaaaattctggtggggaataaagctgatatggatgaaagcaaacgggctgtgcccacttcgaaggggcaagctctcgctgacgaatacgggataaagttttttgaaacgagt

SEQ ID NO: 79036 - DNA, 153 bp, Zea mays
  Clone ID: LIB3088-004-Q1-K1-A1
actaagatgaagccgctggctgtaaatccttgagccatagagagctcatattaacacgcgccgatgcggctacctgaccatctgctgattcttccactagcaatgtaaatgctgatgacacatatattccagatggacgtgccatatacaagc

SEQ ID NO: 79037 - DNA, 496 bp, Zea mays
  unsure at all n locations
  Clone ID: LIB3088-004-Q1-K1-A10
atcgcggacgcgtgggcagctcgcttcctcctcctcccagcgcgcagcgtggtcgtcggctggcggcggtgcctggcagacggcgctggtgctgctggctggcggtggctcgggacgggcgtctgcgagcggtgagactgcgtgcgaggtgacgtccgtcggtgtgcgccgtgcactcgggtacgccgatgggctagcgcggcgtcgccactccgcggcagtgctgcagcggggttgcgctcgctcaacagaccgcgccgtcgtcggcgtgcggactcggcatggccactctgcaagctgcctcaagagcantgtacgggcccggctcggcgggcggcgtcagtcatggccaacgccgacaacattcccggcaagtgcggcgtctccgtcggcgtgcccatcagccccaccgtcgactgcaccaagatcaactgatcgatggaaccatagtggaggtagctcgctcgttggatgcagcgtacgtggccatcagcag

SEQ ID NO: 79038 - DNA, 387 bp, Zea mays
  unsure at all n locations
  Clone ID: LIB3088-004-Q1-K1-A12
gcgctccaaacgcagcagagcccctagcgccgtcggtctcttcagcctcgcagcacaccgtcggcatccggagtgaccgctgcagcctanggtttccggcggcgatggcgggtaagggagggaagggtctgctggcggccaagacgacggcggccaagagcaccgacaaggacaaggacaggaagaaggcccccgtgtcgcgctcctcccgcgccggccttcagttcccggtgggtcgcatccaccgtcagctcaagtcgcgtgccttcgcgcacggtcgcgtcggcgccaccgtcgtcgtctattccgccgtcatcctcgagtacctcaccggcgaggtcctcgagctggccggcaacgccagcaaggaccctcaggtcaagcgca

SEQ ID NO: 79039 - DNA, 375 bp, Zea mays
  Clone ID: LIB3088-004-Q1-K1-A2
ttggaaagaaagtgagtatcgcgcgatcagatccaagcaagggtaagaagagccgtgaagcaggtagagcaagccaggataatgtacctccgagtggtggtgatgatgcaaaagcaacaggatccagtggaccagacaatgaagtacccaagggtgatgcaaaaaccatagggaagaataccctttttgcaccacgagctctggttaaacctcttggatggacaaacaaggatgagaagaaaccagatgttgcaagggagttgaaatcaaatgatgagttccgaaatctgttactaaagaagtgatatcagttggcaggtgtggatcttcatgccccattcaatgccaagatttgtgggccttcatctctatgtt

SEQ ID NO: 79040 - DNA, 181 bp, Zea mays
  Clone ID: LIB3088-004-Q1-K1-A3
aaaaaaaaaaaattataaaatataaaacattttaaaaaataaaaaaaaataaaaatataaatagaatatttataaatacaaaacaatccataatttaaaaacaaaaacatacaaaactcaacaaaattaatttatcaaaacttattaaaaattctcttcccttttttaataacccaatttt

SEQ ID NO: 79041 - DNA, 391 bp, Zea mays
  unsure at all n locations
  Clone ID: LIB3088-004-Q1-K1-A4
cccacgcgtccgcccacgcgtccgcccacgcgtccgtgcagtcgccacgccgaagcagatcagggagctgatgaaggtggacgggctcaccaacgacgaggtcaagagccacctgcagaaatacaggctgcacacgcggcgcgcgtcgtcggacggcggcgaccagcacgcgggcgggctgtggtcgtcggcgccggatcagcagtacacgacgtcgcagcacagcacgtcgcagtcgcagtcgcagtccgggtcgccgcaggggccgctgcagctggcggtgtcgagcagggccatgtcggccaccgncggggacagctgcgacgccggcgacgaggccccaggcggccggtcggagagctacggctgggagatgccgcaacacgggacg

SEQ ID NO: 79042 - DNA, 468 bp, Zea mays
  Clone ID: LIB3088-004-Q1-K1-A5
cccacgcgtccggacaactccctaccgtccgagaccccaagcaccagcgcggcggcggcggcggcggcgaccatggctgtcgggaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaagtttgcctagctgatcttcagggtgacgaggatcaagcttacaggaaaatcaggctccgtgctgaagatgtgcagggcaagaatgtgctcacaaacttttggggtatgaaatttaccactgataaattgagaaccctagtgaagaagggcagaccttaatcgaagcccatgtgatgtcaagacaaccgccactac

SEQ ID NO: 79043 - DNA, 457 bp, Zea mays
  Clone ID: LIB3088-004-Q1-K1-A6
cccacgcgtccggccacgcgtccgtccacgcgtacgcccacgcgttcgcccacgcgggcggggacgcgtacgacactgtgtaccgcacagtcacctggtgcagctgcaaggaagagattggatactgataatggtgctactaccaactcaaaggctaaaagtgtttctcagaaggcaatgggggcatcttcagccaggaaggagaaacataaggacccatcaatgcagattaagggaactgagtgcataaacaccaccacgtctatagaagagcacttgcacaaggagctccccgacccagttgatctgaaatccatggagatgactgtacctgatcagcatgagccatctttcaatgaaccagaacatgtactcaaagacgattggaaattcgagggtcatttctctgaagagaaaggagatgcatgagctaatgagattcataatggaaggcaag

SEQ ID NO: 79044 - DNA, 262 bp, Zea mays
  Clone ID: LIB3088-004-Q1-K1-A7
gttggatccagtgacgaggtcgagtacagcctgttccctgtgcccaagcacggcttgccttgcggattatggagacaaaacaagtgcttcgtcgacagaaaggggcgtgagaccgacgacgatgatgtggaggatattttagtttgactcttgagttaggcatgaatttaaccctcaagctagctagagaagttttttttccctttgaaatatttctttgctcgtctttcttctggatcaaattactttggtggacaagaaa

SEQ ID NO: 79045 - DNA, 376 bp, Zea mays
  Clone ID: LIB3088-004-Q1-K1-A8
gcgcttgaataagacaaaggtggaacggaaacctgatttaaaggctgaaagagaggctgttagtgctgctgaaaaggcagaaagaaaggcacagcttatagacaagaaacgtagggaagagatggagaggcttgagaaagagaagcaggctgatatcatgagctacaagggtctaatggtccaagagaagatgacttccaacaagcaaatcgcttctggcagcaagaccctgcaggaacttgaagaagactttatgtgagaggcggacattataaatgccatgctgaagatttccttgaactgcttctgtcgaagacagaatgggtaccacaggcttgtgagatactggatctaaatgactcatgtgcaggccatg

SEQ ID NO: 79046 - DNA, 434 bp, Zea mays
  Clone ID: LIB3088-004-Q1-K1-A9
acgattgagcagttctatatttacaaagaggccagatattatctgtaagtggctcggtccccgtggtagtgattgtggtatagtgaatgtgaacatacctactaatggtgctgaaattggtggagcatttggtggagaaaaagcaactggtggtggacgagaagcagggagtgattcctggaagcaatacatgaggagggcgacttgtacaatcaactatgggagcgagctacctctagcccatggaatcaattttggttaatcctgcagaaatgttgcgcgtggatctcggtgttttctgcagacgtggatgccgtatggaaagaactgatgcaaccgcatttgagatctcagcagacttgagcagcatttattggcgtcagttgtgaaacttaaactgcaagagcatcttgtacataaataaaataagatgt

SEQ ID NO: 79047 - DNA, 391 bp, Zea mays
  unsure at all n locations
  Clone ID: LIB3088-004-Q1-K1-B1
gttggatccagtgacgaggtcgagtacagcccgttccctgtgcccaagcacggcttgcctgtcagattatggagacaaaacaatccggtcgtcgacagaaaggggcgtgagaccgacgacgatgatgtggaggatattttagtttgactcttgagttaggcatgaatttaaccccaagctagctagagaagttttttttccctttgaaattcttctttgctcgccttcctcctggatcaaattacgttggaggacaagaaacggcagctttctctttcgttttctttgcctgcttcaccgcgacgataatggtgaaaatatgtaagctacgtggacatcaatgatccacagcatncgtgatatatataatatagagagaaaattctctgca

SEQ ID NO: 79048 - DNA, 463 bp, Zea mays
  unsure at all n locations
  Clone ID: LIB3088-004-Q1-K1-B10
cccacgcgttcgcccaagatagcgcatccctttttggtggaggtggtactactgggccagcgcggtgtcgtggacgctctacgggctcctgacctctcagttcggcgacctggaccagcccctgcttatggccgacggcgtcacctccaccaccgtggtggctttcctggaggagcacttcgggttccgccacgacttcctcggcgccgtcgcggcaatggtggccggcttctgcgtcctcttcgccgtcgtcttcgccctggccatcaagtacctcaacttccagcggcgatgagagagcaatgcaagtggttcagctagctagtatagtagccaccgtcgacagacccaccaaacggatcgcagcctactgtacatgcatacaccgatcgatcagtgcangatggcagcagcgcaatgaattatgaatgcgatgtaccagcgcgtcgtatgggcacagtta

SEQ ID NO: 79049 - DNA, 330 bp, Zea mays
  Clone ID: LIB3088-004-Q1-K1-B11
gcgcacaggcttaatacaatcagctatctgtcaagaagcctgatctagataacccctggcctgagggaggacagaactacacatgtgtataagttgtagtctactagcctggtcttttctttgagttgtgatgcaagtactctttgaatccatgttatcaggagcatgtcttatgattagctagaggattctcttcggcgacgatgaatatatttagctagtcattttaatattgggatgtgtgatactgatggtaatgcccgtagttatcgttcactcagcttatatgttgtgaaatccaatgatctcggcgagatgatcatatgatat

SEQ ID NO: 79050 - DNA, 292 bp, Zea mays
  Clone ID: LIB3088-004-Q1-K1-B12
gcggaaaaaccttgctaccaaaggcatcgccctgatggcctacccttctggtacagtatgcaggccatgggaaccttagcggtctgaatagtcatgattagctcactgactcaacaagtgatggtggtgtaaaatgagattcttgcctgacggcagttatcacattttgaagactaacaaatatcgccatctctggatgtggtattctacagggtaggggttccaagtttgactcaccaattaaaacatgcatgtctggttgtataacaagcaatgaactccgtatatatac

SEQ ID NO: 79051 - DNA, 383 bp, Zea mays
  unsure at all n locations
  Clone ID: LIB3088-004-Q1-K1-B2
ctaggtcttcacgggccatggatgatgacctccgtgaaatgaggttaagcctgttgaccgagattgagaggaggaagcaagcagaagaagcacttgagatatggcagaaagaatggaagaagctgagtcaccacctatcacatgttgccttgtcacttccatctccaagtatagctgaggatactgatgattcaagcatcgatcctggagctgagttgtgccagcaaataactgtttcacaacttgtagccgctgctatttcccaggattttgctcgtgctgaagttgaatcagagatggaaaccgtgattgccgcanagaacttcgagattgcaaggctgtcngatagggtccagtactatgaagctgcaaacagggaaatg

SEQ ID NO: 79052 - DNA, 239 bp, Zea mays
  unsure at all n locations
  Clone ID: LIB3088-003-Q1-K1-H5
ccgaatcncaattccgacccagccgacgcgtccgcggacgctatggccaagacgcgtatcttagttcgtctcgtgtttgttgttgcccagggggggttttgattgaaggtcgctctctcccanttctaattgctgtgttaatcctcggttccagcagacccatgcttaaaccagcttggactgcggatcgatgggtgctgttacccccgtcaggctttattctaagttaaatcctaagg

SEQ ID NO: 79053 - DNA, 390 bp, Zea mays
  Clone ID: LIB3088-010-Q1-K1-B1
cccacgcgtccgctagttctagatcgcgagcggccccctttttttttttttttgcactttgtcggtgctatcctgtaactagaatcacacaagataaccatgtttacattttacagcaaacgaccaccagtaagacctcatcaagcaggctacaaaaaccgagcttgctggaatggatgttcatcacacaaatctaacaatcagtctctgtaatgtacatcgacctacctacacatatggcggcatccatggactgtttgttagcatggcatttgggcagccttcctttcatcaccttctaatagctcttttgctcctgtaactgctaagagtcgagagcccccctgcaaatactgacatctcatagggtggagacgagggctggatcga

SEQ ID NO: 79054 - DNA, 434 bp, Zea mays
  unsure at all n locations
  Clone ID: LIB3088-010-Q1-K1-B10
cccacgcgtccgatctgggttcgtttggtttttcgggaagccttgccctccaatgganggcactttatcaggtggtcagaagagtagggttgcattcgcgaaaataaccttcaagaagccgcacatcattctccttgacgagccttctaaccatcttgatctggacgctgttgaggcgctcatccagggtttactcatttttcagggaggggtgctgatggtgagtcacgatgagcatcttatcactggaagcgtggacgagctttgggtggtgtcggaaggcagggtgaccccgttctcgggcactttcaaggactacaagaagatgctcaagtaacaaaaacatgtattatcgaccatagcctatatatctatatgcttgctattacggtgtattaccgtataaattttggagtaaagcatcgaattattat

SEQ ID NO: 79055 - DNA, 334 bp, Zea mays
  unsure at all n locations
  Clone ID: LIB3088-010-Q1-K1-B3
cccacccgtccncggacccctggggtcccaagttcggtcattttagttcgctgctttagggcatgtcttaacccaggtccttatttttctcagttctttttaagccatgccaagggctgtattccccgtatacggtacagatcgcgaaatccctatcagggatggtttggtgatatcagggtttatatgttttcctgaccgtggtgactgtcctgttttcattcttctttcttcgctgccctgtattcattttgtcaagctggggcaggcatccaagtatttggcaatgtatatttgagcttgcaggatacaaaggaaacgaattgttttgtat

SEQ ID NO: 79056 - DNA, 323 bp, Zea mays
  unsure at all n locations
  Clone ID: LIB3088-010-Q1-K1-B4
agaagaaagaagactttccttgataccttgtgcttatcaaaatgcagttgatacaaatntgtacgtaccattctcccatcgaataaagtctgacaatttattcctttttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcccttttaaagaatcaaaattaacttccccgtgcttgcaaagaaaaagtttttttttggggcccccaaaatta

SEQ ID NO: 79057 - DNA, 441 bp, Zea mays
  unsure at all n locations
  Clone ID: LIB3088-010-Q1-K1-B5
actgagaagaaacctccaaacacctacctctctacgaactacctgccgccggaaaacccgagagcgctcgaccatggatccgcagcagccggagcctgtcagttacctctgcggagattgcggagctgagaacaccctgaagcccggagatgtcatccagtgccgtgaatgtggctaccgcatcctctacaagaagcggacccgccggattgtccaatatgaagcgcgctgaagagtgaagacaagggaaaacactgaagatggttgatctattactcgccacattacctatgtaaacagtcttctgggggaaatgaaaatgtcagacttaacgtttgtatgtcgtgtgcctcctttgaacctgagctgtataatttgtaacgcttggactggggactgattngagaactgagacanctgcagcatatgttgatggatcct

SEQ ID NO: 79058 - DNA, 276 bp, Zea mays
  Clone ID: LIB3088-010-Q1-K1-B6
cccacgcgtccgcccacgcgtccgcccactcgttcgcccacgcgtccggcaaattgattaggttgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaattaaaaaaaattaataaaattaacctaaatttaaaaaatttgttaatttaaaaaaatcttacttaacaaaaataaattaacttttattaaattaatttttttt

SEQ ID NO: 79059 - DNA, 402 bp, Zea mays
  Clone ID: LIB3088-010-Q1-K1-B7
ctcgaaggagaatttccattcgacccgatatacttctcacctcaatcttgcgagaagcgaggccagaagaggagggtgcgaggagatctccagcagcctgagccggagccggagccggaggcctagtagatgaagacgttcgatccgtggccggtcttcttccgccgggagtggaagcgcaattggcccttcctcacggggttcgtcatcaccggcttcatcatcactaagatgacggccaacttcaccgaggaggacctcaagaactccaagttcgtccaggagcacaagaagcgctgaccaaccagttatctatgacatggacgccggatggcactggcagagggattgtgtacggtgttgtccgaattgcctgtctggacagccagctatgttatgctg

SEQ ID NO: 79060 - DNA, 208 bp, Zea mays
  Clone ID: LIB3088-010-Q1-K1-B8
cccacacgtccatccacacgtgcgtccactctttcgcaagaagacacactccatgggctggtcctctttccccccactcttagagcacaatacccagcaattctaccagcaagaatcctcaaaactgctcaaccagatccaaattctgcaaaacactaacatgcactttgtttttgactctatttgaaacttgttactcaaatagctc

SEQ ID NO: 79061 - DNA, 399 bp, Zea mays
  Clone ID: LIB3088-010-Q1-K1-B9
gaaccagaaggatcaggctcatggtattcatgggtaaagggtggccgaggtacgcaggcgggtgacagtggtgatgggcggaactggaaagacgaggttgatccgttccacataccgtcggactacacctgggtcgatgccaccgagaagaagcggaggatgaaggcaaagaaagccaagagcaggcggaccacagcccgaaaacagtcctcgaagaacacttcttcggaaggaggccaccgccccatgatggatggcttcgaggagtaaaccgcgttctcacaagcatagtaagttgtatttgcattcttaaaatgttagttgttgatggcagctgcacgccagaggcagattgattgatgttgtgcctggagcaccccctccctttgcgtggcaatg

SEQ ID NO: 79062 - DNA, 399 bp, Zea mays
  Clone ID: LIB3088-010-Q1-K1-C1
cgggcggacggacgcgtccggaaccacaaggatcacgctcattgtatttatgtctaaatggtggccaacctacgcactcggtggactgtgatgatggactggacttaaaataccacctttatccactacacataccgtcacactacacctgagtttatgcctccaatcataagcggatgattaactctttagaaagccaagatcactctgaccacaaaccgaaaacaatccttgaagaacacttcttctctatgaggccaccgccccatgatggatggcttctaagagtaaaccgcgttctcacaaccatcttacgatgtatttgcattcttaaaatgttagttgatgatggcattctcacgccaaaggcagattgattgatgttgtacctggagcacc

SEQ ID NO: 79063 - DNA, 243 bp, Zea mays
  unsure at all n locations
  Clone ID: LIB3088-010-Q1-K1-C10
atcccggggcggccgcacccgtccgttattttttggtggccttccttcttagaattccaaggcaagtccctgtaatttgggggggttttgtaggttgcacccttgtggtcattgtttttgaaattttctgttttgaattgatccattatatatgaagaaaaaaaaaaaaaaagggcggccgccctttnttttttttttttttttttttttttttttttttttttttttttttttttaaagaaa

SEQ ID NO: 79064 - DNA, 351 bp, Zea mays
  unsure at all n locations
  Clone ID: LIB3088-010-Q1-K1-C11
atctcctcgcatttcttcccatccgatccccccttcgcaaccaaaaccccaactggcccggcatcgatggcgcccaaggccganaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatc

SEQ ID NO: 79065 - DNA, 315 bp, Zea mays
  Clone ID: LIB3088-010-Q1-K1-C12
aaaaaaaaaaaaaaaaaaaaaaaatatatatttaaaaaaaaaaaaaaaaaaaaaaaatggccgtttatatataaaaaaatacatactaaaaaaaacctccaaccaatttaaaatctcacattctttcttccccttacttacaacctcttaccttttatttacaaccacctaaattcatttaacttaccttaatttcacatcaatccacctgcaaaaaccttctctttccctaattaaatccctttccaacacttccccctttatccatctttcttataatttaacaaccttaatcctatctcctttcccaacttt

SEQ ID NO: 79066 - DNA, 289 bp, Zea mays
  Clone ID: LIB3088-010-Q1-K1-C2
catccttctcaactatcttttatcctcatgatattaacaaatcatctacggtactatccaaaatatacatctgatataaattattatcttatattactacattttacctaaactattttacatctaatataattataagttcataatcttatatatattttctatatatgatcttcaactatagtaatctcatcttatttattaccaacataatctttattacttaaaaaaacatcatatttatatttaatctaactatcctatattttaattcatacatacataaact

SEQ ID NO: 79067 - DNA, 316 bp, Zea mays
  unsure at all n locations
  Clone ID: LIB3088-010-Q1-K1-C3
caggaggagccgctccttctgagacgacatgataaccatggtgtactgctgtttccagcttttgtaccactttgcactgcttttcgtctctctccgattccgtcgaagcacaagggtggctgctggtttaggtcgcaaaggcagaaactcggcagtcgtagggaccattaccagcatagagcaagcacccagctgagggagtnctatggaggaaagatacccagaggagcgacgcgagcggaggccatcaagcggggacgccgagcaggctgattacacgcggctacagcacgtgccatgcatgctgcttcgcgac

SEQ ID NO: 79068 - DNA, 359 bp, Zea mays
  Clone ID: LIB3088-010-Q1-K1-A9
cccacgcgtccgctagttctagatcgcgagcggccccctttttttttttttttgcactgggtcggtgctttcctgtaactagaatcacacaagataaccatgtttacattttacagcaaacgaccaccagtaagacctcatcaagcaggctacaaaaaccgagcttgctggaatggatgttcatcacacaaatctaacaatcagtctctgtaatgtacatcgacctacctacacatatggcggcatccatggactgtttgttagcatggcatttgggcagccttcctttcatcaccttctaattgctcttttgctcctgtaactgctaagagtcgagagcccccctgcaaatactgaca

SEQ ID NO: 79069 - DNA, 186 bp, Zea mays
  Clone ID: LIB3088-010-Q1-K1-C4
tattgatatactcttttcaatataggaaccatagtccgtataagcattatcctattgatggtgtcgaggatcatcttgtcgagaggaaaataatttctaacagggtgaggacaagaacctagggatgatcaataggataatgcttatacggactatggctcctgtattgatatgcgtttttcaata

SEQ ID NO: 79070 - DNA, 444 bp, Zea mays
  Clone ID: LIB3088-010-Q1-K1-C6
cccacgcgtccgctttgttgctcttgccattctcactctcttctactatgctatatttggatggggaaagaggaaaccaacaggaagattccagctctcaaattgatttgctctgtaagtgaagtttgacggattcatcatatgtgccccctgagtggtagttcagttagcatcttagaaatgtatatgatcaacaaaaccaaaccaatccaaaccaaatcatcttcccaaagagttgaggaactgcaaatgatcaactctgagaccttaaaggccagaattatcaactctgagactttgaaggcaagaatggggcaactgttggttaccacggacatggatgttaaagtagaacccagttgactttgcaatgtacacatttcttgtatcggctcttcatttacgtctgtattaatcgctttatgattggatgatgatgttatt

SEQ ID NO: 79071 - DNA, 233 bp, Zea mays
  Clone ID: LIB3088-010-Q1-K1-C7
cggacgcgtgggtgccggtggttggttcgggtcgccttttttgtttcagcagctgctgggttgcgcgcgtgcgtgagatttggtttggtttcgttcccctgcaatgtaatcatgtcgtgactctcaagggattattccgctctgctcttatggtctctgttttctatttaatgattgttattaccatgtagcagtaaccatcgtcatcagtgagaaccttgttgcttctgtct

SEQ ID NO: 79072 - DNA, 360 bp, Zea mays
  unsure at all n locations
  Clone ID: LIB3088-009-Q1-K1-G7
cttctatttaaagattcaaacaccaggctgttcctttaatacatcatgatgcatccctgaagttggtgtcattcacacactgcaccccattactcttatcaaactcatttctcattacccaaattgtaacaaccggcttctattctatataatttatgcccaacagaactttgtataaccatctttttaaaaaacgtgctgatcctttttcatggacaataaggctcaaacttgccatttaatcttctacgagcttgtcatttttacatgatgctgaaaaccaagtcatatatcgtgatttcaaagcatcaaacattcttctcgactcagaattcaacgcanaactttcagattttggct

SEQ ID NO: 79073 - DNA, 273 bp, Zea mays
  unsure at all n locations
  Clone ID: LIB3088-009-Q1-K1-G8
ccaacccgtccgaaacccattcctcccatctcccatgacctcctcagacccnataagcggagctgggtccatggacgccaccggcactgtatctggagggaaggcaaaaaanggagcggccggtcgcaaggccggcgggccgaggaagaagtcggtgacgaggtccgtgaatgccgggctccagttccccgtcggccgcatcgggcgctacctcaagaagggccgctacgcgcagcgcgtctgcagcggtgcccccgtctacctcgcggccgt

SEQ ID NO: 79074 - DNA, 215 bp, Zea mays
  Clone ID: LIB3088-009-Q1-K1-G9
cccacgcgtacgtccacgcgttcgggcgcaaaccttttcaaccggccgcagcccaactccgccaccgtctacgactggctctacagcgacgagaccaggatcaaccaccgctagatcgggcgagatggatggacagtgaagaggccatgtttgctggtccttgggggtatctaaaacgcacgcatgctctaatatagctagtcatcactatatat

SEQ ID NO: 79075 - DNA, 255 bp, Zea mays
  Clone ID: LIB3088-009-Q1-K1-H1
gtcacctctgcatccttccaacctaactaatttccatacatccaaggacctttggggcggactgaattctgggtggcgcagaccatcttttcacctaacggtgatggactaagacgagatcatgccctaccgctcggagctatgacatggagatcgctgaaatatgtgctccaccacaagagcacaactgcatgctcatgaacaggattgtgcacaacattgctcgtggggaacaagaggactggtacaggcgcc

SEQ ID NO: 79076 - DNA, 317 bp, Zea mays
  Clone ID: LIB3088-009-Q1-K1-H3
agccgattcggccttccgctctccgtgttgccgagctgcggcgggcgttgcgcctgcctggcctcgccagtcccctcgcctctttctcgtttgcggcggcgtccacagcatctgcggctcctgccaccacgtttcggctgcgaccccttcgcccggaatacgaatgatgagagcaggataaggatagcaaaagcaattatgcgctgcagaagtcctttgcattgcagttttccactggaaggttgtgatgcaaggtacaaaagataacttgtagacagaaaccataatgcctgaccctgcttattcgatctcaatta

SEQ ID NO: 79077 - DNA, 405 bp, Zea mays
  Clone ID: LIB3088-009-Q1-K1-H4
gccggcgacggctgcttaaccctgcccgatttcgtcgccctcatggagtccgcgtccggggacggcgtcttcgtagaggaggacctgcgccactccttcatggtcttcgacgccgacggcaacggcctcatcacgcccgccgagctcgcgcgcgtgctgcgcggcctctgggagtccgccaccgtcggccagtgccgccggatgatccaaggcgtggaccgcaacggcgacggcctcgtctccttcgacgagttcaagctcatgatggccgcgggcggcggcggcggattcggcaggatcggtgcctatgaacaaagatcctgtgcctgtcctgctctggctctgctttgcttcgctcccacaaattggatttctctcattttatgtatgtacatatactacact

SEQ ID NO: 79078 - DNA, 374 bp, Zea mays
  Clone ID: LIB3088-009-Q1-K1-H6
gttgtagatcgagagctgccgccatagatgaccgaaacctcctggggctgacggggtgcgggtgccgctgcggcgagctcttctgcggcgcgcaccggtactcggaccggcacggctgcagctacgactacaggggcgccgcccgggacgccatcgcccgggagaacccggtggtgcgcgcggccaaagtcgttaggttctgatccacgacgggaaggaaggacacaacacaaaggctcgcagggcggagaaggggagaaaggcgtgcagacaaggtcttcggtgttattattattacgctgttcctttgattttaatctcctttttttttaaaaaaaaaatatttgtcctatggctatgggaatgggaggaga

SEQ ID NO: 79079 - DNA, 261 bp, Zea mays
  Clone ID: LIB3088-009-Q1-K1-H8
tgccagttcatcatcaccaccgtggaaggaagcatgtgctaagtgcacatttccgggctggatgcaagcattggagaaactacagatggacatagcaacttccactgatttgcttggtgttgaaaccagaagcacatgcttcattttctccattggaaaagaacctctgaaaacccgtccttcagtggttgctctgggtgaacgaataaacattttgaagtgatacctcggttggcgtcgcacatgatgccttcaacacat

SEQ ID NO: 79080 - DNA, 364 bp, Zea mays
  unsure at all n locations
  Clone ID: LIB3088-009-Q1-K1-H9
ntccgagcgagtggtgatggtgaagtgtgtcagaaatagatcggagaaaaatgaaatagaaagcagggcagcaacaagaaaaaaaaagtgtgttacctcgtgaggctttggtaatgctgctggttagattcgtttgtggccacagcaccgacgcctcacgcagtcacgcctgcccgtggaatggcagatcggcatagataagctacagtttccgtcctgtgcaactgtacgttagatgcccttgacctttgatatatagagtcatcgtcgggtggcatccaatggtaatagtcctccatatagtgtatttctgcaatctggacattggacctatatttatatatagctgtaagcataagaggac

SEQ ID NO: 79081 - DNA, 426 bp, Zea mays
  Clone ID: LIB3088-010-Q1-K1-A1
gcgtccggcagctttagctgaacagcagcatatgcatggacagtcttctagtgcatcggcttgccaggcaacaaggtttgacatccttagcagatcagacagatcctttacggaggatctgagtgtagttgggaacagttcttcatactccagagtcgacgaaccgtctagcagcagtacgcaccgaacagtagagggttcaaacggctggtggtccgaggtggctgaggctggaaccaggatcgctgaatctgatgttacagtggaggctggtgttggcaattcgtccacttcagctgtgtccaacattggctcgggcagtgttcctgatagctttcaagagcagatgatgctagccatggctctttcgctggtcgatgcgcgtgctatggcaggttctccaaggttagcttggcggtagcgttt

SEQ ID NO: 79082 - DNA, 361 bp, Zea mays
  Clone ID: LIB3088-010-Q1-K1-A10
gaacaaaccgcgcgagtcgacactgaaagggattgtcataggaaggcgcaacgctgggaggaatacaaccttcagattgcgtggattattggctggcgtggcactctagtctgtctttccactttactgacccaacatcaaacaaatcatggtcttggacaggaagaaagacaggaaagctaacctgtattacctgagggacaagatgaacacacttaaaagatgaggatttcaacttgtttctatgattacttttgaggcgagcggatcaccatggtttgtcaatatgcaatcacattgtttggggttgcatctttgaaaaaaatcatagcttggggttgtcaggtcgcatgctccgatc

SEQ ID NO: 79083 - DNA, 350 bp, Zea mays
  unsure at all n locations
  Clone ID: LIB3088-010-Q1-K1-A12
cggacgcgtggggtgcactttcaaccttgacataatttctgtgaagaaaaacccagatggtccgatgtacacttctcttggtgttatgacaaggggaacaatcattgaggtaaatgtcagtgagcttggtctggtaactcccgctggaaaagttgtttgggggaaatatgctcaagttacaaacaacccggagaatgatgggtgtatcaatgctgttttgctagtgtagaaccatagtgagattttgtttatggtgatgaatcgtcccatttgtatctgctcttgataagatgctcccttttgaccgatctcatggctcttccnnaataaaaaaaagtttaaaataaaaa

SEQ ID NO: 79084 - DNA, 525 bp, Zea mays
  Clone ID: LIB3088-010-Q1-K1-A2
cgggcgcgacgcacgcgatacggcagctcttaactcaacatcaacactaggcattgtacagatcttctagatgcattctgctttgcccgacagacaatggtttgacgatcctgtagcaatatcatgacatgattcctttactagttagatattggagtgtcagtttggtgaacaggctatttcatgactctcatattacgacagaacacgatctagcatgctagtaccgcactcgaaccagtaagaggtgttcaaaccggctttggtggtcctgagtgtggcatgaaggctttggaactaggaatcgcttgaatttcttgatgttacccagtggaggctttggtgttggcaatttcgtccactttcagcttgtgtccaaacattggcttcgggccagtgtttcctgataagcttcgaggagcaagatgatgcttagccatggcttctttcgcttggtcgatgcgcgtgctagggcaagttcttcagggttagcttggcggtagcgtttgttagtaggccatttta

SEQ ID NO: 79085 - DNA, 388 bp, Zea mays
  Clone ID: LIB3088-010-Q1-K1-A3
acccatacaacaacacatactctaactctagatttgcgttctcaaccacttattttttttattacgagagggtcaatactaaactgtgactagactcacacaagataaccatctttacattttacagcaaacgaccaccagtaagaccttatcaagcatgctacaaaaaccgaccttgctgcaatggattttcatcacacaaatctaacaataagtctctgtaatgtacatccacctacctacacatattgcgccatacacgcactgtttgttaccatatcatctggacagtcattctttcatcacataataattgctcttctacgactgtcacaactatcagtccaaagaccatcttcaaatactgacatttcaaaattttgataca

SEQ ID NO: 79086 - DNA, 447 bp, Zea mays
  unsure at all n locations
  Clone ID: LIB3088-010-Q1-K1-A4
cggaannncccgggtgcgacgcgcacgccgtccgnngttctgaagtcgagtacaatgccagagaaggtgaaatgttgagttgcagaatgaccaacttgtactggaaggagtctcgggttgatgagagatgagaagggcacaaaacagacagcgaacatgatgnggggcactcatcgacaatgtgagtatctagcagcacggttttactccttatgatccaataaggagcttcctgcagttcaacatcgtgcagcagcctcagttctattctcagcaggaggaccggaaagacttcaacgaccaaggtggaagataaatattggacctctcaagcttcagtacttatccgtgatgatgcatgactgccagtgagaaactgagctacattacttggggattatatgtaaagactagtactactgctttatatatgtgcatgtgcgcaca

SEQ ID NO: 79087 - DNA, 165 bp, Zea mays
  Clone ID: LIB3088-010-Q1-K1-A6
gttttgcgccatttgagctgggggatgcatctgtatcgggcccataatgtagtatctccgttttgaaaaaggtttgagtttaggaaaagaattgtttactgtagtgattcaataacccttcaccctgtctgcattacaactttcatatatgatgtgaacgttttg

SEQ ID NO: 79088 - DNA, 381 bp, Zea mays
  Clone ID: LIB3088-010-Q1-K1-A7
gcagctttagctgaacagcagcatatgcatggacagtcttctagtgcatcggcttgccagacaacaaggtttgacatccttagcagatcagacagatcctttacggaggatctgagtgtagttgggaacagttcttcagactccagagtcgacgaaccgtctagcagcagtacgcaccgaacagtagagggttcaaacggctggtggtccgaggtggctgaggctggaaccaggatcgctgaatctgatgttacagtggaggctggtgttggcaattcgtccacttcagctgtgtccaacattggctcgggcagtgttcctgatagcttcgaggagcagatgatgctagccatggctctttcgctggtcgatgcgcgtgct

SEQ ID NO: 79089 - DNA, 275 bp, Zea mays
  Clone ID: LIB3088-010-Q1-K1-A8
tcgacacagaatcaaagtcgaagctgccaatcacagagcttcgtagcgtattaccaaatggaccgacttaaagatgaaatgaccaatacgtccatgatagcttgtattatgattgtaatcatttctaaagggcatgaatgtaatttctcacacaaaaaaaaataaaaaaaaaacacaccaaacaaaaaaaggatcaaacagatggtggtccaaagtgactgaagctggggccacgatctctgaatctgatgttacattcgcggctgttgatggca

SEQ ID NO: 79090 - DNA, 399 bp, Zea mays
  Clone ID: LIB3088-009-Q1-K1-G6
ggaagccggaaacctttgcctggctcccctctgcgctgctctaggagaagagatttgggccatatttctgccagccagtcattgctggacttggagatgacaacgtaccattcatttgtaccatggactgcctcggtgcaaaggagctggccaaggattttgttgtttctggaacagcatcagaatctttgtatggtgcttgtgaatccatgtacaagccggacatgcaacctgatgaactcttcgagactatatcccaagccctgaattcatcagtagaccgtgactgccttagcggatggggtggctatgtgttgattgtgacaccgactgaagtgagggagcatgtgattaagagcaggatggactaaataatggccactagaattattagctggg

SEQ ID NO: 79091 - DNA, 381 bp, Zea mays
  Clone ID: LIB3088-009-Q1-K1-D9
aaggctctgtttgccggccaagccacctttcccatggccctgtccctaacaccacctaagtctagtgcattggccaaagtggaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggctgtcctggcggacaatggcaggctgaaatatattgaacgcattgcggagagatttgttgatttgactatggaacataagggggagatgaaggttgtggtcaggacagttatttcactcaccaaggaggaggagaaagaactc

SEQ ID NO: 79092 - DNA, 326 bp, Zea mays
  unsure at all n locations
  Clone ID: LIB3088-009-Q1-K1-E10
acccacgcgtncggtgttgaggggaggtgatgacggccctgtcgtggttagggaagtactcnnngatgtaggttgccaggttgcacttgggtcttcnggcaacagtgacttggtgactgtccttgcgaacgaggtcgaggtcatcaggccgaagaagagcgacaggatcaagatattgaacggcaatttccgtgggtacacaggaaagctcataagtatagatggttctgacggaataatgaggcttgacgaaacatacgaagttaagatcttagatatggtgattttggccaaactggccacttaagatcttagatgtatatgtt

SEQ ID NO: 79093 - DNA, 115 bp, Zea mays
  Clone ID: LIB3088-009-Q1-K1-E11
aaaaaaaaaaaaaaaaaaaaaaaaatttattaaaaaaaaaaaaaaacaaaaaaaaaaaagaaatttattaaaaaagttgggacgccaaaacaacaaccaccctctaacaacataa

SEQ ID NO: 79094 - DNA, 295 bp, Zea mays
  unsure at all n locations
  Clone ID: LIB3088-009-Q1-K1-E2
tcggaanacccggggcgacgcactcgtcctcccactcttcctctcatctacatttcttttctcaccttagtctacatagaataccgtccgtttttattgtagcgcaaggaccactccttctcctatctacccccttacctcgtgatggacctccttccgcaccagacgtgcaacctgctcaagacctctttctttctttgcctcgtgctctatgacgcgcgcctgttctcttcgctcatgtccaacacctttaactacatctacaccagcacactgctcaagatcccttacctca

SEQ ID NO: 79095 - DNA, 86 bp, Zea mays
  Clone ID: LIB3088-009-Q1-K1-E3
ccaacccttcctccaacccttcctccaactcttccgccaacgcttccggtacaatgtacgtgtttatgtaactggttaccagtgtt

SEQ ID NO: 79096 - DNA, 419 bp, Zea mays
  Clone ID: LIB3088-009-Q1-K1-E4
cccacgcgtccggtgcatggaatacccacataatgctgtgctcatcctctgttcatcccgcgataagggctgccgtccttacatgtgtggaactagctaccgccactcgaattgcttggatcagttcaagaaagcatacaccaagggggcattgcttgaggaagttcctgcaaatagcgttggcactgatctggattcagcgccattggatgcagaaaaaatcgagtccattgaccttgcatgtccattgtgtcgtggcaaggtgaaagggtggacagtggtagaaccagctcgaagctacctcaatgggaaaaagagaacatgcatgcaagacggttgctcattcgtggggacctacaaggagctccgcaagcatgtcaagttggaacaccctcttgcaaagccaagggaagttgatc

SEQ ID NO: 79097 - DNA, 156 bp, Zea mays
  unsure at all n locations
  Clone ID: LIB3088-009-Q1-K1-E5
gaaatcccgnggtggacccacccgtccgcccacccgtccnaaaaaaaaaaaacaaatttatttaaaaaaaaaaaaaaaaaaaaaaaaagaagggtttaaaaaaaaggggcgcccgttttaaaatacccacccttacttccccttccttccaacatt

SEQ ID NO: 79098 - DNA, 362 bp, Zea mays
  unsure at all n locations
  Clone ID: LIB3088-009-Q1-K1-E7
acactcactattccttttcactgttcctcacancanctaagtctagttcattttacaaagttgcctctcacattaaagctnttttacacgcttccaagaaaagcccgttgttttctcaattcataaaagacttgtcagttccaaaatctaccatggtgaaggctataaccaaaatatttgctgacgctcttttttcagatcttacaaataatttcttggctgtcctcgcggacaatggcaggcttaaatatattgaacgcattgcggaaagatttgtttattttactattgaacataagggggaaatgaacgttgttgtcaagacatttatttcactcaccaaggaggatgataaagaactc

SEQ ID NO: 79099 - DNA, 408 bp, Zea mays
  unsure at all n locations
  Clone ID: LIB3088-009-Q1-K1-E8
ggctccntcgtctcgtgccatcctagggtttctttccccgtcggcgcctcctcanatttagtttggacgcctccgccgccgctgacccatgttgtcttgatggcgcccgctgtagaatccgtgaaggagacaggctcgttccagaaggttcctgccttgaacgaaaggatactgtcatccatgtccaggaggtctgttgctgcacacccttggcatgatctggagataggtcctggtgctccaaccatattcaactgcgtcattgagataccaaggggcagcaaggttaaatatgaacttgacaagaaaactggactgatcaaggtggaccgtgtgctgtattcgtcagttgtttaccctcacaactatggattcattcctcgcactctttgtgaagacagtgatccc

SEQ ID NO: 79100 - DNA, 308 bp, Zea mays
  Clone ID: LIB3088-009-Q1-K1-E9
cggacgcgtggggcgcgttgaaggatgttggccccaagtaacttccttggctttggagacggaaccgtactgtatctcaacttaaatcggaaaagaagtgtatcaccaaaggattgctaccgagacattcacctggcttgagctggcttttgctatagcgtgcaaggggttgctgggtgtcgtacctacctgacttatcattatctgtggttacattctggaccctgtattttctatgctttcatgtctctctactttctagtattaattatcaataagttggtttggaatggttgaattgcatccaa

SEQ ID NO: 79101 - DNA, 258 bp, Zea mays
  unsure at all n locations
  Clone ID: LIB3088-009-Q1-K1-F11
tcggaggaaccctatcgtaacactgtgcatgttacggcggcgcgctaccggtnacgggtgatgctgctgcatcgtgcccctcggcccctcctccatccccggcgcggctgcgccagcagccggcctgcagctttataatggatcccaacatgaagcagcttcaagaggctctggttgatattgagactgatgcagaaaaagctcttctggctagacatcagttggtggaaaatgataagataagaaatggttacaggg

SEQ ID NO: 79102 - DNA, 262 bp, Zea mays
  unsure at all n locations
  Clone ID: LIB3088-009-Q1-K1-F12
cccactcgtccgcccacgcgtccgtgaagtctcgtgtcttggtatgacaacgagtggggcgacagcaaccgggttctggatctgatcgctcacatggctcttgtgagcgccaagcactgatgttcgtactcgttcctccagtaccagtagtagcctagataagaggctgcagttttgacggccattttcttttagctgttgtttggaataaaagaccaaatgttggaacacttggaactcgcgcaaaactggaatccgnttc

SEQ ID NO: 79103 - DNA, 92 bp, Zea mays
  Clone ID: LIB3088-009-Q1-K1-F3
catggcgcctctgcttgattcgtgtttcatctgttatgttctgagattcatgatgatgcggtgagaactgaaaggcccgtggcatgcttctt

SEQ ID NO: 79104 - DNA, 284 bp, Zea mays
  Clone ID: LIB3088-009-Q1-K1-F5
gtcggattttgttctcgttaaagtgatcagggacacattgtccgacaggttaccatccaaatcggggggggtttagggccctgctgcagatattcctggtggaagcctacctccattgtccgcattgttttaatcgtagtgaagcatagggttcactcaacaaactaggcagcccttttctggtttagtcagtgctgcaaagcaatcgagttgttcagaattttcttgtgttgcaagatgaccacaacgacaactgtagacgtatttcagaatttttatcaagg

SEQ ID NO: 79105 - DNA, 423 bp, Zea mays
  Clone ID: LIB3088-009-Q1-K1-F7
gcggcacgtctctgaactcgaagccagtgacgcgctgcctgcggtcacaggatacccccgcgcacgagcataatgatgcagcagcattccatttgctggcaaggatgccaagggggtccttgagcattgctttgaaggcgagcagcgcatcaaggtctgtggcactggatggtggtggggtgagtgcggcggcactacttgctgctgtgactgcgagcaagatgagtaccatgctgacgcggacgaacaagaaagccattttggtgagagtctatgagtatgattgacagaatatggatgtggtgacgacttgactgctgctcttatatgcagctttggacgtccagttggctcaagtggttggaaacgtacagcgatctgaagccaacttttgttgaatatggtcagcaagctgtttccttt

SEQ ID NO: 79106 - DNA, 225 bp, Zea mays
  unsure at all n locations
  Clone ID: LIB3088-009-Q1-K1-F9
tgctgatcctttgtcatgggcaataaggctcaaagttgccattggagctgctaggggcttgtcatttttacatgatgctgaaaaccaagtcatatatcgtgatttcaaggcatcaaacattcttctcgactcagaattcaacgcanaactttcagattttggcttggcaaaagctggtccaactggggataaaacccatgtatccacacaagtcatgggtactca

SEQ ID NO: 79107 - DNA, 413 bp, Zea mays
  unsure at all n locations
  Clone ID: LIB3088-009-Q1-K1-G12
cgnccgcccacgcgtccgcccacgcgtccgcttttcccgagctctcgaaaccctaggtgcgtgccgaccgtctgcggcggcgaggtgatggcgatggacccggacgcggtggcgaaagccttcgtggagcactactaccggacgttcgacaccaaccgcgcggcgctggtggggctgtatcaggagacctccatgctcaccttcgagggccagaagttccagggcccatccgccattgccggcaagctcggatctcttcccttccaggcctgcgagcaccagatcgtcaccgtcgactgccagccgtcggggccccagggaggcatgctcgtcttcgtctccggttccatccgcaccggccccgaggagcaccccatcaagttctctcaggcattccatttgctgccggcagc

SEQ ID NO: 79108 - DNA, 422 bp, Zea mays
  unsure at all n locations
  Clone ID: LIB3088-009-Q1-K1-D8
ctgctcattactacgaggatgagactgctcctactggcacatgtgctgtatgtgttgggggtggggaaaggtcattgattgcaaatctgtcancngcaaactgttacaaatctgagcatctaaagagaccagagaactgggcactagttgaaaaggcaaaatacatctacattgctggatttttccttacagtgtcgcctgattctatccagctagtcgctgagcatgctgcagcaaataacaaggtgttcctgatgaacctctctgctcccttcatttgtgagttcttccgtgatgcccaagagaaggtcctcccgtatgctgactacatcttcggcaacgaaactgaggcaaagatctttgccaaagtcagaggatgggagactgagaatattgaagagattgctttgaagatctctcaa

SEQ ID NO: 79109 - DNA, 170 bp, Zea mays
  unsure at all n locations
  Clone ID: LIB3088-009-Q1-K1-G2
acgcccaaccctccncaatattcattttttggttgtgtctggagttagtcagttcagggcttgggtatgtattatatactgngattacaacacaaggttctaggttgtattaatgatatgtcctgatcattcctgtgcccgttcaaaaaaaaaaaaaaaaaatatttttt

SEQ ID NO: 79110 - DNA, 249 bp, Zea mays
  Clone ID: LIB3088-009-Q1-K1-G3
ctaaaaccgccgtgccagggtgttggaggtagtggtctagttactatataggtttgctgaaaaaaaaaaatgatgtaggattttgactgagcagagcagggggtctgaaaggtggaaggaagggctctgcttggttttcctgcacactgctcctctgtttgcgtcttctgtggcggcggcggcaatggagactgtcacagacgtaagatgtcatgtgactagtgcccgccgttgccaacactaatattc

SEQ ID NO: 79111 - DNA, 333 bp, Zea mays
  Clone ID: LIB3088-009-Q1-K1-G4
attttaaaacttataaatgttttatacattcaaattgtaattctttttaatcattttctggtggaatcactccgatgattgggtaatgtaaacttattgtaacatgtaatcattttgtaataaagaatttatttccgctgcggaaaaaaaaaaaaaaaaaaaaattaataaaaaaaaaataaaaataaaaatcagactaataaggctctaacataaaaaaaggccaatacacgcaaaaatatatctactatagcccctgtttacctggcggtcgttctggagtacctacccctttatgtcctggaactcgccggcaactctttctatgacaac

SEQ ID NO: 79112 - DNA, 444 bp, Zea mays
  Clone ID: LIB3088-050-Q1-K1-E6
cccacgcgtccgggagaagcaccccaatgtgaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaagactttctagatgcagtagattagtgccgtcttctgagtagtttccttgcaagtgtcgtcccgtccctggaatgaggcaatttagtttggaatttcttcgcttcatc

SEQ ID NO: 79113 - DNA, 165 bp, Zea mays
  Clone ID: LIB3088-050-Q1-K1-E8
gtcgtcgtacgcgttcagcggcgagctggttgccgcgatgcaggagatgagccgcgccgaggtgcgcaagtacatgtccggcgcggggctccgcgccggatgcgggcccggggccgtgggcgaggtgtgcatgccgtatctggtggagggtgtgatgcgcgccgt

SEQ ID NO: 79114 - DNA, 349 bp, Zea mays
  Clone ID: LIB3088-050-Q1-K1-E9
gccaggcgctcggcggccacaagaggaagcactacgacggaggcgccgcgacgtccgaggtggggagctccgggaacggaagctccgccgcccgcgcgttcgacctcaacctcccggccgtgccggagttcgccttccggtgcggcgccaagcccggcaagatgtgggacgaggaccaggaggtgcagagccccctcgccttcaagaagccccgcctcctcatgaccgcgtgagcctgagcctgagccgaggcgcggatctgatgttgatccgcacgagacttttttggatgttcggtggaacactattcgttcgttcaaaaaaaatttttattattttttatgttttt

SEQ ID NO: 79115 - DNA, 435 bp, Zea mays
  Clone ID: LIB3088-050-Q1-K1-F1
aaaccctagccgccatatctcacgatccactcgagcaccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacg

SEQ ID NO: 79116 - DNA, 304 bp, Zea mays
  Clone ID: LIB3088-050-Q1-K1-F2
gaccgacgcgtgcgaaacgctagccgtcatatctcactatccattcgagcacgatgccgagggaaagtgacgagggatgtctcgcagaatggcgtcggccaatgtcgtcgcggtctctcgcaaaaaaaatgtgtagggtcttttgacaatcgattgcatcaatccattagatgacaatatcatgtatgtggacttggtctatatgttcctacaggaccgcatcttggccgcctgcagaggacctgtgcccatttaacactatagaaccatgtgtgaccagaatactaacttaaccgtaacctca

SEQ ID NO: 79117 - DNA, 454 bp, Zea mays
  Clone ID: LIB3088-050-Q1-K1-F3
cccacgcgtccgcggacgcgtgggctgcgagcaaggagcatggggcaccagaagatgagaaccgccatgctggtgatcttggaaacgtgacagctggagcagatggtgttgctaatatcaatgtcaccgacagccagatcccactgactgggccaaactcaatcattggcagagctgttgttgttcacgctgatcctgatgatcttggaaagggtgggcacgagctcagcaagagcactggaaacgccggtggccgtgttgcttgtgggatcattggactccagggctgaaaacgatcgccggacttgggggtgcctgagaggtccgtctcctgccgtccccagcagacgagcctgaacattcggagacatcgtgaaataagagcgtcgctgatctgtgatcatcgtatttgtcattatgcacctgtagcaaccgatggactgaactgtgctgg

SEQ ID NO: 79118 - DNA, 353 bp, Zea mays
  Clone ID: LIB3088-050-Q1-K1-F4
gcgccaacccttccgcggacacgtactctgcattcaaggatcatgacgcaccacaagatcagggccgccatggtggtaatcttggaaaccagacagatggagcagatcgtgtcactaatatcaatgtcactcgacagccagatcctactgactggcccagactcaatcattgccagatctgtttgtgttgacgctgatcctgatgatcgtttaaagattgggcacgaccttagccagaccactggaatcgccgcatgctcatgtcgcttgaggtatcacagtactccagcgctgtataccatcgacggacttgggggagcctgataggtacctatcctgccgaacccatgaca

SEQ ID NO: 79119 - DNA, 213 bp, Zea mays
  Clone ID: LIB3088-050-Q1-K1-F5
accattccgcaccaacagatgatgggctccatgcgggcgatcttgtaaacatgacacgctgcatcagacggcgttgataatatcaatgtcacctacagccacaaccgactgactgcaccaaactcaatcatcatcagagctgtctttgttcacactgatcctgatgatctcgtaaaggttgcacacgagctcagtacgagcactggaaactcc

SEQ ID NO: 79120 - DNA, 359 bp, Zea mays
  Clone ID: LIB3088-050-Q1-K1-F6
ctcgttctgctctgcctctccccggcatgcgccgccgggagagtcccggtgtcggtctagtacgaagcgctgtgcccgttctgctccgcgtttgtcgtgaacgacctctccagggtcttccgcgacgggatctcctccatcgctgagctgcggctcgtcctttccgcaatgggcctttctcggcccacggaaccgtcacttggcaacattgaaaggaccagtggccaactcaacgctatagaagcttgcgtgatcagaatatggcctgacgcggagcagcattttcctttcattcaatgcgttgagcatttagcactgactcggaaatgggactcctggcagtcttgctttcatgaaac

SEQ ID NO: 79121 - DNA, 219 bp, Zea mays
  Clone ID: LIB3088-050-Q1-K1-F7
cgcccgagccaagcgttcggtcgatctgctctgcctcatcccggcatgctccgccaccagagtaccagaggcggcatgcggctaatcgctgaaaccgtactgctgcaccatagtcgtgaactaacattaaatggacttacaggcagatatctattgacatggctcaaactcaatcattggcatgagctgatgttgctcactctgatcctaatgaacctt

SEQ ID NO: 79122 - DNA, 435 bp, Zea mays
  unsure at all n locations
  Clone ID: LIB3088-050-Q1-K1-F8
gcagcacagcagctagatagcgcgcgctcatcaccaaagccgagagccaagcagccagctaattaagcagccaaattcagtgcgatggcgtcgtccgtcaccagaaccgcatgtctcctcgtgctcacactgttcgtcgtctccgcggcggtgatcttgcccagctccctgtgccatggagcccgcggcgtcgcagggttacgtatcggtttggaccctaaccatcctgcgtgcatccgggcatgctcagctcctgngggctcctacactcgccttcccccctatcgcggtggcggccctgtggaaccgcttcccccaccgaacggagggaacccctgacgccgnctgcctacgatggaacgatgcgccacgcacaactgtatcttagctgtgcttatatagtatatgtgatcaataaaactggagtagtgctcg

SEQ ID NO: 79123 - DNA, 184 bp, Zea mays
  Clone ID: LIB3088-050-Q1-K1-F9
cccacgcgtccgatcggctgcagttgcagaactgcacggatgtgtacgagactgggctcgctccacatcgtcgattaagttgtaaagcagtatatcttgctcgcttagtaattttagttgggttgaaagaattgtaaattaaaacaattttggtagttgattttaatgtcgtatttcttatacc

SEQ ID NO: 79124 - DNA, 199 bp, Zea mays
  Clone ID: LIB3088-050-Q1-K1-G1
aaaaaacatacaaaaaaaaaaaaaaaaaaaatcaaaaaatatttaaaaaaaaaaaaacaaaaagaaaaactaggacaaaatcaaaaatcaaacacaaattaaacaacaaacatctaaatacataaaaatataaaaaacctcaccacatttaaatcgaatatattcttaattccattactatctataacataacttattt

SEQ ID NO: 79125 - DNA, 391 bp, Zea mays
  Clone ID: LIB3088-050-Q1-K1-G10
actacgcgttcgcccacgcgtgctggcacgcgtccgactaatctactctacaccagatatggttctcagttctttggtgcgcagtcagagaggcagcggcgatgtctgggcgcgtcaaggtcggcatgggtctgatccagggcggcgcgaagcgccaactgaaggtgctacgcgacaacatccatagcatcaccaagccgatgatccggaggctggttaggatgggtggcgtgaagctcatctaggagcttatatactaggagacccgaagcgtgctcaagatctttctcgagaacgtcatccgcgacaccgtcacctacaccgagcacgctcgccgcatgaccgataccgtcatgtacgtcgtctacgcgctcaagcgctagggacgcac

SEQ ID NO: 79126 - DNA, 411 bp, Zea mays
  Clone ID: LIB3088-050-Q1-K1-G12
cggacgcgtgggcgtcgcactcgcccgacgaggagtacatgggggagttcgcggagccggggtggctggcggagcccatggtgaaggcggcgttcgagaagttcggcggcaggatgaaggagatcgaggggttcatcgacgagtgcaacaacaacctggacctcaagaaccgctgcggcgccgggatcgtgccgtacgagctgctcaagcccttctccaagccgggagtcaccgggaggggcatccccagcagcatctccatctgatccatcctcagcatgcattagtccaattaattaaatcgggggttgtactattattgcatgcagaggctgcttgtcgaataaaacgtactatatgtacgattgtattgtacatgtgtgtcaatgcaacaagaggcacgtttgagac

SEQ ID NO: 79127 - DNA, 313 bp, Zea mays
  Clone ID: LIB3088-050-Q1-K1-G2
tcggcagcacatcagctcgatatttcgcgctctttaccaaagccaacagccaagcagtcttgtgattaatcagccaaattcacagcgatcacgtcgtccgtcaccagaacctcatgtctgctcttgctcacactgatcctcgtctccgtggtggcgatcttgcccaactccctatgccatgcaaccagggctgtctcagcaatacgtatacattgggaccctaatcatcctgcctgcatacgctcatgctctgcttctgtgtgctcttactctactcttacgctctatactgtcggcgtcccttatgaacctt

SEQ ID NO: 79128 - DNA, 340 bp, Zea mays
  Clone ID: LIB3088-050-Q1-K1-E5
gccattaaggatgtagttaccagattcaacaagaccaatggattcatattgtattggttgacttccgatacccgcttgcatttgcatgtatggttggcagctgtctttgcaaaaaaaaaaaaaaaaaaaaaaaaaaaaaaaaaaaaaaaaaaaaaaaaaaaaaaaaaaaaaaaaaaaaaaaaaaaaaaaaaaaaaaaggacgaacaatctaaaaagatccaaagctaacatacacaaacatgcaacgtcataactttaatataagtgtcacggaaattcaattaaaatggccgtacttttacaaattcgtgcctggaaaaacctatgcgtttcccaactt

SEQ ID NO: 79129 - DNA, 208 bp, Zea mays
  Clone ID: LIB3088-050-Q1-K1-G5
accgcaaaggcgcgtgccgagggtctagaatatacgatcttcatgcactcttgacgagttcacgcgcaactaactcatgaaagccggattccaataacacatacgaactactgtacataagatgtcctttggacctatgaatatgaaaatgattgatatggaatcagatgggatacatgagcgataggttcgatggaagactcgagcg

SEQ ID NO: 79130 - DNA, 362 bp, Zea mays
  Clone ID: LIB3088-050-Q1-K1-C5
cccacgcgtccgcggacgcgtgggggaggtgtatgtcaactcaactcaatgggactatgtgaaggtgggcctgagtcatgactgcggtttcatgcctgcaattctctagtcagtagtataaatactagtctgcgtgttttctaatatgaagatccatctattttattacttaaccatagcgtagatgattggtaacagatagatacattttatttactgattaaaatgcagcagcgactccccgaacttaaaacaggtaaacgggtgtggaaacttagtggctcattcaaaactgtctaaaatcgggtttgctcaaacaaagtgtcgacatggcatgtcatgttgaaatcatttgagtctct

SEQ ID NO: 79131 - DNA, 259 bp, Zea mays
  Clone ID: LIB3088-050-Q1-K1-C6
cccacgcgttcgccacctactgccgcctatcggtagaaggatccgacgggggatacccgtcagatagcgatggaccgttcgaactgcgctactgccgggcttagaacccgagacactcataactaccttactagggactagagcccatacagtgatctactaaatcccagtacagtctcgagtgtcaagagaagaatctgaacctagaagagctactggatcctgatggtagagacacacgatgagcactccaagacgg

SEQ ID NO: 79132 - DNA, 181 bp, Zea mays
  Clone ID: LIB3088-050-Q1-K1-C7
cgcggatcggcctgcctgagctcaacatctacgcacacactcgcaggcacagctagaacggaccgccgcatccacccctctgcctgaagctgttcggttttctttttgtttcccaatgcgtctgtggtctgatctctttgtaatgaaaacgcgcagctcaattagaatgaacttcagttgg

SEQ ID NO: 79133 - DNA, 408 bp, Zea mays
  Clone ID: LIB3088-050-Q1-K1-C8
gagccacacgtgctccaactcctgagcactttatcttagtactatacaagccaatcgaagccgggatacgacggtggactgcatcggcaccggagcatggggtaaggggaagaagggagcggccgggcgcaaggtcggcggtccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgacgctgatgttctggagctcgccggtaatgcttccagggacaacaagaagactcgcattattccgtgccacgtgcttctggcgatccggaacgactaggagcttgggaagcttttggg

SEQ ID NO: 79134 - DNA, 309 bp, Zea mays
  Clone ID: LIB3088-050-Q1-K1-C9
cggacgcgtgggaaaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaataatataaaaataaaaaattaataaaaaattatataaaaaattataattatatataataatatataataaattaaaaataatttttttatttattaaaaaattatatttttggaattatattttttaacttttttaattttttttatttttaattttttttatttatttttttattatttt

SEQ ID NO: 79135 - DNA, 253 bp, Zea mays
  Clone ID: LIB3088-050-Q1-K1-D1
cccacgcgtccgcccacgcgtacggaatgcttcacatgtactttcttatgagtcatgactgctttgcaggttcattttctatatagataagtgaagttgcattaagtgtgtgttgagtcgattattgtcgtattatcctatgaaacccctttattttcatggtatcgaaaaagctctatcgtgccagataaacataggctccttgcctcaatctgctgtaatcttggtggttcactggacttatggttcctga

SEQ ID NO: 79136 - DNA, 440 bp, Zea mays
  Clone ID: LIB3088-050-Q1-K1-D11
agaagatggtggtggtggagcaggtgggcgagcccgtgctcggctacgacgacttcgccggcagcctccccgccaacgagtgcaggtacgccatcttcgactacgacttcgtcaccgaggagaactgccagaagagcaagatcttcttcatcgcctggtctcctgacacggcgcgcgtgaggagcaagatgatctacgccagctccaaggagaggttcaagcgggagctggacggcattcaggtggagctccaggccaccgactccgccgaggttggccttgacgtcatccagggccgtgcaagctgaggatgcccagcgatgaactgcccatgccagaggatgtatgagcatcatcagttccgatgagaacttaactgggcgggctatgtaaaaactgcatccaccgcagtgatgaaatcaatctagtcaatctaccac

SEQ ID NO: 79137 - DNA, 62 bp, Zea mays
  Clone ID: LIB3088-050-Q1-K1-D12
aaaaaaaaaaaaaaaaaataaaaaaaaaaaataaaaaaaaaaaaaaaaaaaaaaacatacgg

SEQ ID NO: 79138 - DNA, 381 bp, Zea mays
  Clone ID: LIB3088-050-Q1-K1-D2
ccgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgtgccacgtgcttctggcgatccggaacga

SEQ ID NO: 79139 - DNA, 457 bp, Zea mays
  Clone ID: LIB3088-050-Q1-K1-D3
cccacgcgtccgcgcacctgcaagggattacagcatccccaaatcatcgcagtcaactcgagtcttcactacgataggttccatagcagaccttgtgtttgcttacaacaccggcatgctgccagaaattcaggcaaccatcaggcctcctgtggtgaagaacatggagaaagctctatggttccagttcaccattggctccttgcctctctatgctgtagtttttgtgggttactgggcttatgggtcctcaacatcaggctacctcctcaacagtgtcacaggcccagtctgggtgaaagcggttgcaaatctgtcggcattttttcagacagtcatagcgctgcacatctttgctagccccatgtatgaattcctggacacaaaatatggaagtgggcgtggtggcccttttgagatccacaacgtggcgttcagagtagcagtcagaggaggc

SEQ ID NO: 79140 - DNA, 436 bp, Zea mays
  Clone ID: LIB3088-050-Q1-K1-D4
cccacgcgtccgcgcacctgcaacgcattacagcatccccaaatcatcgcagtcaactctgttcttcacgacgataggttccatagcacaccttgtgtttgcttacaacaccggcatgctgccagaaattcaggcaaccatcaggcctactgtggtgaagaacatggagaaagctctatggttccagttcaccattggctccttgcctctctatgctgtagttcttgtggcttactgagcttatgggtcctcaacatcatgctacctcctcaacagtgtcacaggcccagttctggtgaaagccgttgcaaatctgtcgggcatttttcagacagtcatagcgctgcacatctttgctagccccatgtatgaattcctggacacaaaatatggaagttggcgtggtggtccttttgagatccacaacgtggcgttc

SEQ ID NO: 79141 - DNA, 72 bp, Zea mays
  Clone ID: LIB3088-050-Q1-K1-D5
aaacaaaaaaaaagaattacaaaaaaaaaattataataaaaataaaaaacgagtataagctctagatcgcga

SEQ ID NO: 79142 - DNA, 347 bp, Zea mays
  Clone ID: LIB3088-050-Q1-K1-D7
cattttagctcataaaatggcttcgagccaaatcatccgtaggcaactcgagtctctacggcgataggttccatagcataccttgtgtttgcttacaacaccggcatgctgccagaaattcaggcaaccatcaggcctcctgtggtgaagaacatggagaaagctctatggttccagttcaccattggctccttgcctctctatgctgtagtttttgtgggttactgggcttatgggtcctcaacatcaggctacctcctcaacagtgtcacaggcccagtctgggtgaaagcggttgcaaatctgtcggcattttttcagacagtcatagcgctgcacatctttgc

SEQ ID NO: 79143 - DNA, 69 bp, Zea mays
  Clone ID: LIB3088-050-Q1-K1-D8
caattccctctcgacccacacgtccgattttaactcataaaatgtcttcaacctttttaccaaaaaaca

SEQ ID NO: 79144 - DNA, 122 bp, Zea mays
  Clone ID: LIB3088-050-Q1-K1-E1
cccacgcgtccgcttaaataccttatgctactctgattgtgttgcaacttgcaactgcccgtgtacttgatagatttgtattagatgctcaagctacagagggtaggttcctaattatgacc

SEQ ID NO: 79145 - DNA, 450 bp, Zea mays
  Clone ID: LIB3088-050-Q1-K1-E10
ctagttctaagatcgcgagggccgcccttttttttttttttttttggaattaatgatgatgcatatacttgcttaaattactgctgacaccgcgttgtgtgtgtagtgtatatatatctatatgtacgacgcatggcatatactgctactcgaactggacgatggagctgtagacgttgtcgggctgccagtctgccggaatgacctggtccgccaccagcgtcttgccggactcgttggtgacgcgcagcgagaagggcccctgcagcggccggcgggtgtccatcctccatatggagccccaggactcgcgcatgggctcccagacgccggtgggctcgccgtcgtcggggctggactccatcaggtccacctgcaccacgtcgccgtcgccgttctcgtactccaccagcaccggcaggtagttggggttggagccacgctcgatgt

SEQ ID NO: 79146 - DNA, 427 bp, Zea mays
  Clone ID: LIB3088-050-Q1-K1-E11
gtcgtggtattagcagtgggggtggtcagagttccttgggctatctctttggcagtgacgaagctccaaaatcatttgagaagcctgcaccagttcaaaagccaactcctccatcctctgcagagagactaaaagatatcgctgctggtattcaaagtagtaaatcaaacaattacaaaagatctgaaggccagaacttgggaaatttccttacggaccgtccgtcgaccaaagtgcaagcagctccaggtggcgactcttcactcggttatctttttagtggcagcaaagatggcaagtgatgtacacctgctgttagtgttcgccatgatcatgggagaaggtttctgcttaacaaaggaaaaagggaaaagaatcttgtattccatgaggtaatatcaaactgctcatggtatctatgttggtg

SEQ ID NO: 79147 - DNA, 234 bp, Zea mays
  Clone ID: LIB3088-050-Q1-K1-C4
attcccgtttcgacaccactcgttcgagccatcatcgcgccgtcctgcgccgtctattgtctcgacaacctggtcatccacatcgagctaaccacgatcgtctgcttcgtcacgtgacccgtgcgtaagagctgaccaagggtagccaatcacatgaaagcagcccctatgacgaactatgtgaccaagccctttaactctgctttcagaatctggaacagaacataggacgct

SEQ ID NO: 79148 - DNA, 442 bp, Zea mays
  Clone ID: LIB3088-050-Q1-K1-E12
tgctttcatgctggagcattctgctttgaagttctgcaattagagtacacttattttgagcattattgtcatgatgctttattttacccagtccctgaaacttttggcaacacaggacttgatgtaaaccagctttagaagaacatttgagatactacagcttctatttccaaaagtttgaatctgtctacacacaaagtgaagattacagtggtgatgattcagaggatgtaaatatacaaaatgggctggtttcactgacacacgatcatatggccctggtttggtgctatgggttctcttttgagttgagtccctatgaagggatccgtcattccgttggacaagaagataatctttaatgaagtcttgggagatctccctaatgtgttgcctcattttccatgaaaaacaggtgtatatatgagaggatcgcggtcaa

SEQ ID NO: 79149 - DNA, 363 bp, Zea mays
  Clone ID: LIB3088-050-Q1-K1-E3
cccacgcgtccgcacaagcgtgcggccacacgtgctcccagacgttcgctacgacaacgcggactacttcgatcgttactgatcttggctgagattagagatctctgactgattctccagtcatgtgatgtgtgtatgtatgctaaatatgtctgtataccatcatggggtacactgacgcttacattgcacatatgtaattatccactgatgtcgtgggtacgtacgcaaaatatgtatgtatgccatcatggtatgcgctgacacttacgtttgacacatatgtgattataaagatcaggctgctggccaggaacactcatcgttgaggtgataggacttaagtgaatcgtacatgagatt

SEQ ID NO: 79150 - DNA, 227 bp, Zea mays
  Clone ID: LIB3088-050-Q1-K1-A2
cggacgcgtgcgaaaaaaaagaaaaataatttaaaaaaaaaaaaaaaaaaaaaaaataaaggaaaaaaaaaaaaaaaaaaaaatacaaaaaaaaaaaataaaaataaaatataaaaaaaaaaaattaaataaaaaataaagaccgagaggttataatcgttcacgtgatataaatgccaacaacaaaatataattcattgataacctaaacaatattgaaattactt

SEQ ID NO: 79151 - DNA, 406 bp, Zea mays
  Clone ID: LIB3088-050-Q1-K1-A3
cccacgcgtgcgcccacgcgtccgcccacgcgttcgtccacgcgtccgaataatatataggcctgtaacaacggcagggcagagtggaaggtcgaccccaccaagcggaggccacggtctgaaactcaaactgggtttcaactgacgctagctggcttggaagctcgaggatggatcgaagactatgatctccttcattgtgccctgtcaggctacctacccctgcaccctgttggttattggttaaaatggttattgaccaaaggtgtcctgcatcaaacaaggctcaccttgatgttaatgtgctgagggatctaatgtatcattagcgttatccagctcttgtttacgtgctccatctcaatccatgcacgttaggatggattgtctaatctagttcaaattt

SEQ ID NO: 79152 - DNA, 341 bp, Zea mays
  Clone ID: LIB3088-050-Q1-K1-A7
tcgacgcgtccgcagcatcttatgcccaagttctcgaggtacttccggacgccttcctatagagactctttcgaatgtgaatgaaatcgaggctctgaatgagctgctcaagaagattatcaatactctcactgattatagctcgattaactaggatgaattccaactagccttatttaagaccatcacaaaggatagcatgttagctcaccgggtcatagactagtttgacacgatacacaacggaattctcgagtttgatgaatttgctcgtgccctttctgtgttccatccgtgtgcaccaatcgatgacaaatttgattttgctttccaattgtatg

SEQ ID NO: 79153 - DNA, 68 bp, Zea mays
  Clone ID: LIB3088-050-Q1-K1-A9
cccacgcgtccgcgggagcgagagtgagaaaaaaaagtaaagagtactgtatagccagctattcatgt

SEQ ID NO: 79154 - DNA, 455 bp, Zea mays
  unsure at all n locations
  Clone ID: LIB3088-050-Q1-K1-B1
gcggtgcactgtttgcagcatccgatccccaagtcccggaatactgcgagacgctcaagtcggaggactggccagtttgtgcctgcattaactatgactgtagtccgatgaatgcgtctgaagaagcgcacaatcttgagacctcgcagctggtctgggagaagacactggagatggtcggccttccgccggatgccctggagaagctcatcgccggagaatcagttcagtgccgttacggacaacaggatacaactttttagttagcagtttagaggtggtttgttcggttgttatgtcattttgatcctaaatttgcagggaggaaaacacagggaagggagaaaaagaatttgttgacagctaccaatctttgctctttttctgtatgtgtgcaagatgttgtgaaggaggcgtagaaacacatctnccccattatttgaaaaaaattaaaa

SEQ ID NO: 79155 - DNA, 451 bp, Zea mays
  Clone ID: LIB3088-050-Q1-K1-B10
cccacgcgtccgcccacgcgtccgcggacgcgtgggcgccggcaagcagctcgaggacgggcgcaccctcgccgactacaacatccagaaggagtccaccctccacctggtgctccgcctccgaggtggcgccaagaagcgcaagaagaagacgtacaccaagcccaagaagatcaagcacaagcacaagaaggtaaagctcgctgtgctgcagttctacaaggtggacgacgccaccggcaaggtgacccgcctccgcaaggagtgccccaacaccgagtgcggtgcgggtgtcttcatggccaaccacttcgaccgccactactgcggcaagtgcggcctcacctacgtctacaatcagaaggcgtaatcccatgcgccgctttgcttcacccgcctacctatcaagcattcacctgttggttactcgatttgaatatcatttagatct

SEQ ID NO: 79156 - DNA, 446 bp, Zea mays
  Clone ID: LIB3088-050-Q1-K1-B11
cccacgcgtccgcagaggtgggctggcttctcctccccctcttaccaagtcctcttcggggtagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcggtggcg

SEQ ID NO: 79157 - DNA, 443 bp, Zea mays
  Clone ID: LIB3088-050-Q1-K1-B12
gcagaaagttgatcctccgtttccgaaggtattacataaggaaaccggatctgttgttcgcctaccagaagctacccggcctactgttcttcaaaaacccaaggacttgcctgctatcaagcagcaggatatcaggacctcttcctcaaaagaagagccctgcttctctggtaggaatgcagaagcagttcaagtgcaagatactaagctctcccggtcagacatgaagaaaatccgcaaagctgagaaaaaagataagaagttcagagatctgtttgttacctggaatccggtattgatagagaatgaaggttcagatcttggtgatgaagactggctgttcagcagtaaaaggaactccgatgctatcatggttcaaagcagagctactgatagttcagtgccgatccatccaatggtgcagcagaagccttctttacaac

SEQ ID NO: 79158 - DNA, 202 bp, Zea mays
  Clone ID: LIB3088-050-Q1-K1-B5
tctgcgggtatctatgctcagtaacaatgtctcagtttatgtactatatagacacgctaacattagtggaatattgagcattttactgccttaactatcactgtatttccacttaatcacctcacaaaatactcttttttcatgactcatacataatttctgcttattaaacttaaaataatacggcctgccgctcatgcac

SEQ ID NO: 79159 - DNA, 123 bp, Zea mays
  Clone ID: LIB3088-050-Q1-K1-B6
gaaatgctaagcaacgaactcgtattatcgattgtggatctctagctttgatatcacgttagagtggacgcactgataaccagtttaacataaaagtttaagcaatccacttatacttttctt

SEQ ID NO: 79160 - DNA, 275 bp, Zea mays
  Clone ID: LIB3088-050-Q1-K1-B9
gctgcataccgcatattcaaagcatcccaggaaggctcaaaaacttcgtaggctgcaagattggatcttacagccggtttggcaagggatgctcagccgcatttgaagattgacgttgctgagaacctgagacgatgataggagaagatacagatagccggtcggttggctttaccttgtgaaacagtatgattgtgatggagttgaagaagaacaaagttgcgtctctcctgtaaatacctgtgaaagtaaaccctgaatccggttacagtctt

SEQ ID NO: 79161 - DNA, 432 bp, Zea mays
  unsure at all n locations
  Clone ID: LIB3088-050-Q1-K1-C1
ctgcagtcaccacagatggtaaacggagtgctcaatttgaacatacacttttggtgacagacacattatgcgaagttttgacggcacggttaccctcatcaccagacgtttttccatggttgaaaccgtgatcgggcaccccaacagctactagaaagtgatactctttatcagtcagtcaagctgaatattttcaaaattttcagaccatacagtgataagcatgctactgctggacagtcgacctaattgtctgtcctgcggaattgtttctgggagtgtgtattgctaagtcggttttgtccgagttatacgagacatatggcttgagtcgtgtcaccaatatgcttatgccatatgactatcagagtntacttttaatttcagagaacataatttccatcaatttcagtaggttcatttttaatgaat

SEQ ID NO: 79162 - DNA, 221 bp, Zea mays
  Clone ID: LIB3088-050-Q1-K1-C10
cggacgcgtgggaaaaaataaaaaaaaaaaaaaaaaaaaaaaaaaaaaaaaaaaaaaaagggaaaaataaaaaaaaaaaagaaaaaaaaaaaaaaaaatggaaaaaagtttttatggtttaaaggttccatacttttgtttgcttggttttaatttttttattttgttacttagtttaatttaattaggtcatatgtttataattttataaactggtaaat

SEQ ID NO: 79163 - DNA, 316 bp, Zea mays
  Clone ID: LIB3088-050-Q1-K1-C11
cccacgcgtccggtggtaaggaaaggtgtcttgtgcagaaacgtccatgctgtttgtgaggtgcactaggagatctagttgaaggtgaaacgccattggacattactacatggattatgggaggtgggatttgggttgggttggctccgaatgcgatgttatgccttagcacgtgatcccccaagaacaataatttttctttcaggcttctccctaaccgaacattggagaggacagcatgtaaagaaatgtaaaaatgtaccggttctcgatcaaaaaaaaaaaatattattaaaattataaattatattaatat

SEQ ID NO: 79164 - DNA, 439 bp, Zea mays
  unsure at all n locations
  Clone ID: LIB3088-050-Q1-K1-A10
cccacgcgtccgcggacgcgtgggttttcatcctggcagtgttgggagcatgggatttcgtggtagccctcagcttcatggtctggagctaaatagcatattttctcacactggtgggagtcgcatggatccaactgtgtcttcagctcagatcagcgcaccatctcaacagagaggtcctatgttccatggaaggaatcctatggtcccccttccttcatttgattcacctggtgagcggatgagaagccggagaaatgattcaggtgttaaccagtctgataataagcggcagtatgagcttgatgttgaccgcataatgcggngggaagactcacgaactacactgatgataaagaatatcccaaataagtatacctccaagatgctcttggctgctattgatgaaagtcataagggcacttatgattttatttac

SEQ ID NO: 79165 - DNA, 240 bp, Zea mays
  Clone ID: LIB3088-050-Q1-K1-C12
cccacgcgtccggccactcgttcgggcaacttcaactgaatttacacatactttacaaggggatctacacaattgtgacatgatgtgtttctacaggcaatcgttgtttactcattcctcaataattctaccctcaaggtaccttgatgatttttacaattctgctttttcggaccgtaaattcaagctattcttcataggccatgctcatttacactgatacttccaaagatattcatt

SEQ ID NO: 79166 - DNA, 282 bp, Zea mays
  Clone ID: LIB3088-050-Q1-K1-C2
ccgaatcgttcggaagtccagaacattttgttgtcgttcgaaacaagccattcgaaattgaggtacaacggtgatctgcagaggtaccgaggcatgtcgttagggatcgaaggcaccggccgagcgcacggtcggcgggccatggaagaagtcgatgtcgaggtgcttgaaggccgatctacagttccgcgtcggacgcatctggcgctacttgaagaaaggccggtacgcgcagcgtgtcggcaccggcgccctcgtctaccttgacgatgtcctcgaata

SEQ ID NO: 79167 - DNA, 412 bp, Zea mays
  Clone ID: LIB3088-050-Q1-K1-C3
agccgccatcgcgccgccgaccgccgtcgacagcctcgacgacctgctcatcgacatagggctagacgacatcgcgagcttcttcgcgtgacccgcgcgttgtagctgaccaagggtagggaatcaaatcaaagcagccgatgtggcgtagtatgtgaccgagccctctggctctgcttcctgaaactggaacagaacagaggagggaagagcaccagagctctgcttcctggggtccatgcagatgcaggatgcaggcgtaaaaacctaggagatgaacaagagtagagactgcattttttacccctctttttttgtgaatcttattgctcttccagaggactgagggtattgtgtttgcattgtattattgattattaatgtcaatgggaaaaataagatccttcgtgcc

SEQ ID NO: 79168 - DNA, 277 bp, Zea mays
  Clone ID: LIB3088-035-Q1-K1-F12
aggcccacgcgtacgcacacaacacatccaatgaaacactccaacggctgggggtgtgctttagcaggtggcaagtgccgataagcatcacccgccaaggcatacggaccaggccaagactagctgcatcaatggagtacgctggcctgcacggaacaagccggaaccatgacataaatgcgagacgttacacggagacgagaaagagcttcgcagagccggagaacttgtacgtgcattgtgacgagcttaagcaacttcgactaaccatggagat

SEQ ID NO: 79169 - DNA, 361 bp, Zea mays
  Clone ID: LIB3088-035-Q1-K1-F2
cccacgcgtccgctcgctgcgcgctgggagccccgccgagttcgctgttgagcaccgccgcgaagactcttcctgccgtgcgtcgtcgcaaggttgcctttggtgcaatctatgcttaggtaaagaagaaggcgtcgaggcggatctccaggagtttcggggctttgatgagttcgaggattaggctagcgactacccccagtcagctgcctgtggtgggtttatttacgttggctacgtttctatttctggtactttgattatattatgttaattgactctagtcttttatattattacttactctttattgtattcgaaagcattgtgctatgatgagtcatttatttaaatctcttgt

SEQ ID NO: 79170 - DNA, 464 bp, Zea mays
  Clone ID: LIB3088-035-Q1-K1-F6
gtcctgaagaacgcaaccatcaaggacggctccgtcatatagagactaactttggccttagtcatggcttgcaaggttacaggttagtcatcgtcttgagagttgagacttagtttgaggcgcgcgcccgaccttgacttgaatcgttggagggacaagaacatgaggaagaagaagggctggtggtgccggatgttgccatggacgactagaaatggtttggtgcggtcgcatctgttccagttgctagctctttcgatgttattaatatttatctagtgtagttgatcgttctgttcttttatcttgtcgtgcttatgtttatgtttacttttggtttgtgtatttgttttttcttttttgtatttattttctttctttctttttttattttttttttttttatttttattttatttattatttttttttatttttttttatttttttttttatgttttttt

SEQ ID NO: 79171 - DNA, 362 bp, Zea mays
  Clone ID: LIB3088-035-Q1-K1-F9
cgggcgcgtggggcatgctattagcgtttgatgggcctctgctgccagactggggggcggattatcgcggtagactagtccattgctaactgactacatcatcgactcaggtgatgctatcgcacatcaagacaaatgtagccactgagccttgatcgatccggggtttggtgtggaggcaatgaatactcttagtgggtattctaacaggagatcatacactacactttatatgggaactggaactgagggtgggattacaagtgctagaatcagggtgccaaatgtaggatgtgaaggattcatgtgctcaagtcatctgtcaatcactcaaagaaattcaagattgatccattctacta

SEQ ID NO: 79172 - DNA, 161 bp, Zea mays
  Clone ID: LIB3088-035-Q1-K1-G1
gtgaaacacaagtcattctgtcacatatgatcgtagatctcaaccagatcctattctcgtgggtcttttcaaacatgggtggtgcatatcaacaataacagaaagtttgttactcaatttattcatcttcttccaactgatctattatcttacacttcagt

SEQ ID NO: 79173 - DNA, 138 bp, Zea mays
  Clone ID: LIB3088-035-Q1-K1-G10
gaaatagacaatggggctacggcagtcgaacactgggcattgtaagaaacaacaccacagggggcgggggactttgacaagggcgaaccaacgtcttggctaacaggcataagcatcacggacatgccaagactagat

SEQ ID NO: 79174 - DNA, 207 bp, Zea mays
  Clone ID: LIB3088-035-Q1-K1-G11
tcgggcgtgcgcagacgcatgggcgcttgctccgctgtcaacaccttctgggggggcatatgccatgggggcgtacaactatgtagtcagaactatggacgaggaagcagtcagacgtgatgcgcttgatgcatagcgtgctccactggtagtacaggcagcacatcgtacatagtgctcctcaccaggcctacccttgacatcatg

SEQ ID NO: 79175 - DNA, 347 bp, Zea mays
  Clone ID: LIB3088-035-Q1-K1-G12
gggtttggacgttgaagaaggggcattgaaagaaacaacaccagatggtgagggggatcatgagaaaggagtgcctgcattttggcttactgccatgaaaaacattgaagtgttggctgaggagatctcagagcgtgatgaaggtgctcttaagtatctcaaagatatcaagtggagcaggatagaaaacccgaaaggattcaaacttgagcttttctttgacaccaacccttattttatcaattctgacttgacataaacatatcatatgattgatgaggatgaaccaatattggagaaagcaattgggactgaaattcaatgggccccaggaaaatgcctgacac

SEQ ID NO: 79176 - DNA, 328 bp, Zea mays
  Clone ID: LIB3088-035-Q1-K1-G3
cccacgcgtccgcccacgcgtccgttctagatcggagcggcgcccttttttttttttttgtgaaaaaaagagattatgtgactaacagtttgctgtacaattatacaacatgaactctcttgagtcacgagtttggtggtggtttggatatgccctctgatccaagaaaagaactcctgagccctcacctggaccttgaaaggggggctaggggggcaaggagaaaccgaaaaaagccgaaaaaggttgcaataagttgctcagcagctgcatgttaccttcggttcagcattcacagtggaaggcagagctagggtctagatcgcga

SEQ ID NO: 79177 - DNA, 458 bp, Zea mays
  Clone ID: LIB3088-035-Q1-K1-G4
gtctgtaaattgatttatcaggacaatcctcaatgtagtggttttggtgtagttcggatttagcactatttaattaagattcgggtccttacatcaacaatgcattcatgtggtctcacagtggcacttttattgaagtgttcgtagctttcaaagttcttatctctttttacatatatgatcacttacttttatagcactattcatagcattattcttcatacttatgtttatctctttgttttttatacttaattcttttatttcttgtctcattttttttttttattttttttcttcttttttttttatttatcttatagttttttatatgttttattttttttgttttttttatctttctattatttcttttttattatttttctgttttttattttttttaattcttatttttatatttttatattttttatttttctattttttattttttt

SEQ ID NO: 79178 - DNA, 294 bp, Zea mays
  Clone ID: LIB3088-035-Q1-K1-G5
cggacgcgtgggggaaaaggtattcgaagaatggaaatctatgcgcagggatgagctgactgtgttccaaaagcaagttgaggagcaatatctctcaaatgtggagaggcagctggagaggatccagaatgcccggaacgctcgaaaggctaacgggcatgctaacatgcaagaaatggacaaggagctggacacacacagggcggagcatggtccgaagactcggcgagttcctgaggagggcggttatgatgactactaatactcttaggacatggctgcttaagactaggt

SEQ ID NO: 79179 - DNA, 457 bp, Zea mays
  Clone ID: LIB3088-035-Q1-K1-G6
atcagctgattgatatttctgaggatggatttgtgagccttcttacttcagatggcaagggtaatgatgatcttagactgcgaactgatgagactcttgtggcccagattaaggaagggttcgaaagcgggaaggatcttgttgtgactgtccagtctgctatgggggaggagcatatctgcgcgttgaaggatgttggccctaagtaacttccttggctttggagactgaaccctactgtttctcaacttaaatcggaaaagaagtgtttcaccaaatgattgctacctatacattcacctgtcttgatcttgcttttgctatatctttctatgtttttcttgtagttttaccttacttttcttatcatatttttggttcattttttattctttatttttattttttattattttttactttttattttatttataattaatttgttttgtttttt

SEQ ID NO: 79180 - DNA, 157 bp, Zea mays
  Clone ID: LIB3088-035-Q1-K1-G7
ctataagcctacatagcgcccctacgattgaatttcactcctaagactatcataatactacgcgcaaaatctaaaagtacgaggaccattcatatctcacctcataacttacatctcaactcagcatccatgacaacaagtcataattttactcgta

SEQ ID NO: 79181 - DNA, 199 bp, Zea mays
  Clone ID: LIB3088-035-Q1-K1-G8
tgatcctctgcttgtttcaaacgcctcacaaagaggtcgatggtcttgttagctgcaggggtgactttttacagcatcggcgtactaagtggctcacaatctatacaacattaactctcttgattcacgagtttgttgattgttacgatatgccctttgattcaagataagaacttctgaacccttacctttactttta

SEQ ID NO: 79182 - DNA, 369 bp, Zea mays
  Clone ID: LIB3088-035-Q1-K1-G9
cgtccgacactccccgttaggtttttgaggataagattgagctgaatggttgccaggagaccgggtttgattgctttgtttgatgttgatggaactcttacagctcccaggaaggtggtcacaccggagatgttgacattcatgcatgaactgcggaaggttgtaactgttggagttgttgggggttctgaccttataaagatatcagagcaacttggcagcacagttaccaatgactattattatgtattttctgagaatggtcttgtggctcacaaggaaggaaagctcattggaactcaaatcttgaagtcattccttggtgaagaaaagctcaaggagtttattaactttacaccttattatatt

SEQ ID NO: 79183 - DNA, 198 bp, Zea mays
  Clone ID: LIB3088-035-Q1-K1-H10
gggtttggtcaaatttgacaagccctagtgtaaattcaaagcacatgaggagggttcatttcgaccggggcacgatactgatcggaatcaacggcatcagaaggatcggcaggctcgatgccagagccatcgtccatagcgaggatgttctgctcctgttcggcactaccaatcacataacgacggtcatcatttact

SEQ ID NO: 79184 - DNA, 331 bp, Zea mays
  Clone ID: LIB3088-035-Q1-K1-F11
ggcccacgcgtccgacactcccctctcaagtgtttgtggataagattgagtagaatggttgccaggagagcgggtttgattgctatggttgatgttgatggaactcttacagcttccaggaaggtggtcacaccggagatgttgacattcatgcaagaactgctgaaggttgtaactgttggagctgatgggggttctgaccctatgaagatatcagagcaacttgacatcacagctaccaatgactatgattatgcattttctgagaatggtcttgcggctcacaaggtaagaaagctcattggaactcaaagcttgaaatcatttcttg

SEQ ID NO: 79185 - DNA, 204 bp, Zea mays
  Clone ID: LIB3088-035-Q1-K1-H11
cctcctcgacgccctatgacctcgtcatgaaagccacgaatcaccagagtgcaagcatgcgagcttctggtattcagaccatgccataacctcacatgggagaggagcagtgaccgatagcgccaccagcaggctgagagaagtgcagtttgacagatcatctacacctagtcgtggccacactgatgtttacttctgggtagc

SEQ ID NO: 79186 - DNA, 270 bp, Zea mays
  Clone ID: LIB3088-035-Q1-K1-H6
gcactcgtacgggaatttctcaagacctctcttaaggaatttttggatgattaatcatccattatctttgtagtcatatttaaaaactatgctgcccattatatatgtcttgactcaatccctcttgagccttccatattatataatctcataaatgcttatctagcatatattaaagagagaaacccaattattctgtatctattctcattatttttgtcttttactataatatcacttctatctatttttattcattattcatacttt

SEQ ID NO: 79187 - DNA, 244 bp, Zea mays
  Clone ID: LIB3088-035-Q1-K1-H8
gcgcgcgcgatcgctcgatccaaagttgcttgtccgtcagccctcagctatcgacactacagtgttattttaggccccgtgttggggagagtccagttcctacgtgacgacgaccaccctcagttcggcgtagatgaaacacaaactagcagaatgcagattgttaggatttttttttcaggctgcggggtggagccattcattgtcatggtgacaggactcatttttgatattcatgtaacat

SEQ ID NO: 79188 - DNA, 218 bp, Zea mays
  Clone ID: LIB3088-035-Q1-K1-H9
cacagaggatctcggccggcagggacgttgcctagggcatacagctactgtacgtatctatcatacctcgcctggatcgaaaccataggcgcatgacgaacgcacatgctcaccagaaccacgtcaacccaattctgctctgcgtccacattaacctggccatggcaatgtggcaccagcactctggacgagcatggcagaactgggactgcacacat

SEQ ID NO: 79189 - DNA, 236 bp, Zea mays
  Clone ID: LIB3088-035-Q1-K1-D12
gagcgcatacgtccacgcgttcggagtcttccaaaatcttccaaggtgacgagctgctctttcctaccggtggacaaggcacagctgatcgaggacgtgaggcatgctctatataccgacaagatctacagttacgcacagggcatgaacatcatcaaggccaagatctaagatacaggattgggcctgaaccctagggagctagcgaggatcttgatggcagggtgcattatacg

SEQ ID NO: 79190 - DNA, 445 bp, Zea mays
  Clone ID: LIB3088-035-Q1-K1-D2
cggacgcgtgggcgcggaggcgctctggcggctctgcggcggtgaggaggccgagattggaaggtcaccttggaccatgccggcgagtacgtccccaagagtgagcgccttgccgacgctgctgggcttattgacgccatccataagttcgtcgccactgccacggacaactgacgtcttgctcacggattactaccatagttcagtgaatatgtcacatgtttcctctttttctgggctagtgcttttgttgcagcttttgttttctggagtctgtcaagaacttgtattcattctggcaaattgtctactctgcttttatgctttgcaagtccttttattttgtatttattatttatattattttatttttttttgtttttgttttatttatttattttatttttttattattttttttttttatatttattttatttaggtt

SEQ ID NO: 79191 - DNA, 427 bp, Zea mays
  Clone ID: LIB3088-035-Q1-K1-D3
cccacgcgtccgcccacgcgtccgtgaagactgcgaggttcaaggagctccctccttatgaccctgactggtactacatcagggctgcatctgtagcaaggaagatctacttgagacaaggcattggtgttggtggcttccagaagatttatggtggccgccagaggaatggctcacgcccacctcacttctgcaagagcagtggtgccatttcacgcaacatcctccagcagctgcaggagatgggcatcattgatgtcgatcccaagggtggacggcgcatcacctcccagggaaggcgtgatctggaccaggtggctggaaaggttgctgttgaagcttgagcaatctcatatttggtttctatgatgtcatgtttgattgttgagatggctacactttatttgcactttggattatgaatttt

SEQ ID NO: 79192 - DNA, 274 bp, Zea mays
  Clone ID: LIB3088-035-Q1-K1-D4
caacatcagggaagaggccagatactagacactgttgctgaaatacaggagcgacatgattcgggaagggatctagagaggaagcttctggagttgcaacagatattcatggacatggcagttcttgttgaggcacacggagacatgatcaacaacatcgagacccatgtctcgaacgccaccaaccacatacagcaaggtgtgagcgcgctccaaaacgcgaagaaactgcagaggaattcgaggaagtggattttctacgtcctcattatac

SEQ ID NO: 79193 - DNA, 419 bp, Zea mays
  Clone ID: LIB3088-035-Q1-K1-D5
acgagcactcgccgccactcaccagcaaattcccgagccgccccttccccatctctttcgcgagccatttgatcgattcctgatggcgcccaaggccgagaagaagcccgcggagaagaagccggcggaggagaaggccgagaagaagccaagggcggagaagcgcgtgccgagcaaggagggcggcgagaagaagggaaagaagaaggcgaagaagagcgtcgagacgtacaagatctacatcttcaaggtgctcaagcaggtgcacccggacattggcatctcgtccaaagccatgtccatcatgaactccttcatcaacgacatcttcgagaagctcgccgccgaggccgccaagctcgcccgctacaacaagaagcccaacattaccttccgggagatccagacctcggtgcgcc

SEQ ID NO: 79194 - DNA, 341 bp, Zea mays
  Clone ID: LIB3088-035-Q1-K1-D8
cccacgcgtccgcccacgcgtccgcccacgcttccgcatcccagcagaagatgccccaggggaccaattcacccctctgggccgaatgctttacaaggcaccatctgatgggaaatggggggagcatgagctcgactacctgctgttcatcgtccgggacgtgaaggtgcagccgaacccagatgaagtcgctgatgtgaagtacgtgaaccgcgaggagctcaaggagctcatccggaaggctgacgctggctaggatggggtgaagatctgcccctggttcaagctggtagtggacaacttacccatgggctgttgctaccatgtctagaaaggcaccc

SEQ ID NO: 79195 - DNA, 135 bp, Zea mays
  Clone ID: LIB3088-035-Q1-K1-D9
ggcggacgcgtgggcggacgcggggtcggaaccaccatccaatgagacggggggccgtattagatgaggggcgcgaccacatggagaaagcagacaccactaaccctaatcccagactttgctttctcgcttccc

SEQ ID NO: 79196 - DNA, 365 bp, Zea mays
  Clone ID: LIB3088-035-Q1-K1-E10
gcgtcgggcgtgcgagcagccgagcgccctattacaatcagccatcgccaccaggtggctccatggctcccccttccgccacgaacacgccgctgtctcgaccccttctcctgctgcttcagcaagatggcggtgattgagataaaaacagcacctgctgacttacgcttacctacaacaaaccaaacaaggcattgtattactcgctatgtcgagtaccacaggtgtttgaatgccaaaggggatgatgctggtgtttgcgaaaaatttgccaagtactacaggtccttttgccctggagaatgggttgagaaatggaacgagcttagggagaacgggacgtttccaggacctttctgaatgta

SEQ ID NO: 79197 - DNA, 385 bp, Zea mays
  Clone ID: LIB3088-035-Q1-K1-E11
cggatgggccgacccactcgtgcgtcgggatcctgtgagtctctactctgctttcacagagtcgaatcctctgacgcagcatgcgtcaaatggcggacggaggggcctaggcatcgccgctgcggccccggcggcgcgtcggctctagggacgagcttataatattgtgccgcatatacgatcaagacaggctcgccttccagattcctatgatacacgtttatcgtaaccaaccatcaatggcagagaaagacccagttcaagtgattcggaaagcactggcaaaaacacttgtgatctattacccttttgcgggtaggcttaaggagaggcctgaccacaagttaatggtggattgtactggagagggcgtcttggtcattga

SEQ ID NO: 79198 - DNA, 298 bp, Zea mays
  Clone ID: LIB3088-035-Q1-K1-E12
tcgacgcgtccggaggctgtgcatatatttggtggccctgctggtttggaggctgggttgctgcggcttagggatttgagcagggtcaatcaggaactacttgttcagactgaagagcttctacagaaggaggcgaatgaagacgctcagtttcgtacacaatttgggagtcgttggactagaccttaatcaagcaccctaactaagaacattcaggatagattgaatctgtttgcttctaatctgaagaaagctgctgatagtgattctctgattgaacgaggcgtgaatgagaact

SEQ ID NO: 79199 - DNA, 393 bp, Zea mays
  Clone ID: LIB3088-035-Q1-K1-E3
ccaagatgaaggaggctgaactgatgctgttaaacccgttgattaatatcaacaatgcttgctccttcagtgttaagagaaggtgggacgacgacgtggtattcaagaatcaagcacgaggagagaccaagacaccgaaacggttcatcaacgacaccatcaggagtgatttccaccgtaaatttcttcagaggtacatgaagtgacgcttccgtcgttcacaattcagcctggagcccctcatcgttatcatgtttgtgtatgagcgaatgatcattattgtgttgttgtatgaaacaagagtgtaaacatatgtctactactttaacaaagttatgctgagcaatgcatattctagttgaatgtttcaaaaatatttttaaaaagggctgt

SEQ ID NO: 79200 - DNA, 442 bp, Zea mays
  Clone ID: LIB3088-035-Q1-K1-E4
cagcaaaaaatacgaaaaaacagccgacaatcaagctgagagggcaaattggtggaggatggcatctggcaagcctaatgtgcttactcttgattatgttaacatcagtccattttcccttccagcaagaaggacaaaggaattaagagctttgattggatggaggtattacttcagcttattcttagagttgtcagatattgccatgcccttcataagggttgctatcagcaaagtgagctctgcggtgtcctacttctgggtgtcaatgattggaaggtctcttgggctgattttctcagggattagacaatcactaggctggaaataagcttatacggtcatacctgttgagttttgagtctgacttctgcgactgaatgaatgtctgttaagttatgcattgtaaatctttgagatggctgtcaaaaataaaaatttt

SEQ ID NO: 79201 - DNA, 288 bp, Zea mays
  Clone ID: LIB3088-035-Q1-K1-E5
cccacgcgtccgcccacgcgtccgcttgataatcataactgtctaaaagagaacggtaatgaagatagttctaaagagctggacaacaatggaagtccaaaagattcaggtgactgtctagcagaacacttcaacagcagtaggatatctggcaatgaggcactggtccttacacctgaaactgattcagtaaatgaatctcttggtttgcaatccaaggatgatcctgggaagtctgttcctactgagcatgagattgaatcttaggtggtggtgactttatagtgt

SEQ ID NO: 79202 - DNA, 213 bp, Zea mays
  Clone ID: LIB3088-035-Q1-K1-E6
tattccctgtcgacccactcgtcctaccacacttctcaccacacatactcaccattcttacaaaaaaatctatcttaaatctaaacgagaattcttaaaaattgcttgcctatcacataattattttatacacaacattattccctcaacttacttttgattcaatcttataatctactatatcctcttaacaaattctattctttttcttta

SEQ ID NO: 79203 - DNA, 328 bp, Zea mays
  Clone ID: LIB3088-035-Q1-K1-E8
aaatgaagctctctgaaactgcttacagccttaaaccagatacactagaagaactagaagttaaattgagtgaggaaaatgtgcagcctccggagcataagtttgaggaacacaaggaggttgaaagatctcatgcggaaaatatgccaaggaaaaggagtaggccaaccagttcaagaactgcaagggctgctcctagagcagtccgccgaataaggcctagaataggaaaccagaaagcaaaaataggtgatgttgaatctgaagaaagtggcctcagctaatgccaagatgatgaaaatttggacacagatgattcctctaatat

SEQ ID NO: 79204 - DNA, 286 bp, Zea mays
  Clone ID: LIB3088-035-Q1-K1-E9
ggctagtccctacccaacagccaacttatacatgccgtcattgaatacgggggcctgatccaataccatggccacatcgatctcgccaccacccgacttaatggctctcgacataacaatatcttaagctcttataaccttctacgacttagactatcaaacagggctatcttacgccaactacatgatccaattggctcgttgccaaacattaaacgcctaaaccgatctaacacaggcgattccgaaaggactccagaaaacacttgtactctaccacacttaa

SEQ ID NO: 79205 - DNA, 426 bp, Zea mays
  Clone ID: LIB3088-035-Q1-K1-F1
gacggttccaacaatgtacatgttcattgttaggtacctgaaagccgcaatgtgtgacacggagcttgagaacatggcattcttctactccgagctggcattggtccattacgcgatgctggtttaccctccatcggtgaccgcagccgctgccgtctatgctgccaggtctacacttgggatgaatccaccgtggactgatattctggaacatcacactggcctagctgagccacagttactggactgcgctaggcggcttatcaacttccataccctggctccggaaagcaagcagaaggcggtgtacaggaagtactccaagcccaagctcggcttcgtcgcgcttcaatcccctgtcaagaagctgttgtcaggttcacaatgaaattctataaagcaattctatacatgggaagaacactg

SEQ ID NO: 79206 - DNA, 309 bp, Zea mays
  Clone ID: LIB3088-035-Q1-K1-F10
gagttagcagcaacacacaatatttatggacaagcacaatttccacattgccaatgaagtacctctgcctggacggtacgagtgggtcccagtactccactaggagtgtcatatggtgataatatgggattacaagagccattagactggtattttaaatctaacaactagaagaagctttgactaaccatttagattgcttgaggctcttggttaacaagcttcaaaggaaacgaactgtttagaaatttccaatattcgattagtagaccagtagtgtctttctgatctgaaaggtgtaccgggggg

SEQ ID NO: 79207 - DNA, 178 bp, Zea mays
  Clone ID: LIB3088-035-Q1-K1-D11
acccaacactatcttcaactgttctcaacttcaagatctttccctctcaaacaatgttatctcaggcaaactacctgagctaattggctgaatgacataccttaaacatgctaacctgtatgacaatgcctttgcccgtttgaaccccgaaaacctcctctactctaccaaaccttaa

SEQ ID NO: 79208 - DNA, 440 bp, Zea mays
  Clone ID: LIB3088-035-Q1-K1-B2
cccacgcgtccgcccacgcgtccgccaagatgtaccagggcgcgggtgaagacatgggcgtcgctggctgcatggacgaggacgcccccgctggcagcggcggccctggccccaagatcgaggaggtggactaagcggtttgttgtcagtcttgagcgtgctgcagttgctggctggcccagtcgctgccgcgagttatcgtcgtcggtcggtgcggtgtgtccgcttaaactttatttgtggggggctgtgacttttgaggtgtttattttttttggacctttggtatattctttattatttcatgtttttttcgtgttcttgtttttttttattgtttatatttttttttgattttttatttttttgttttttcttatttatttttattatttttcttttttttttttatttttcttttttattttttttattttttt

SEQ ID NO: 79209 - DNA, 283 bp, Zea mays
  Clone ID: LIB3088-035-Q1-K1-B3
aaaagttcccccactcgccagtcgcagcagcacctgtagccatggacgccagcggagcgtgtagcatttggaagaagggtgcggccgggcgcaaggcaggcggccccaggaagaagtcggtgacgcggtccgtcaaggccgggctgcagttccccgtcggccggatcggtcgctacctgaagaagggccggtacgcgcagcgcgtgggcactggcgcccccgtctacctcgccgccgtcctggagtaccttgccgtctaggttctggagttggcttggaacgc

SEQ ID NO: 79210 - DNA, 256 bp, Zea mays
  Clone ID: LIB3088-035-Q1-K1-B4
gagccgtcgcgttgagaagcattggcgccttatcggatggggccagatccaggcaggtacaagacttgtattaccagcgtgcgcggtgtaaagcgtcatactcagacgtgagctgaagttgagtgcaaaagataaaaaagagtttgttgttagtcctgtccctgcgttactgcagattcaaagttctgggtcactctaattttatcttgtttcgttcaattttggaggccgttagcattatgactcctgtgaacat

SEQ ID NO: 79211 - DNA, 255 bp, Zea mays
  unsure at all n locations
  Clone ID: LIB3088-035-Q1-K1-B5
aaaagtcctactactaattaagcttcgagagtgggcgcctggcgatgccatgcccccgcgtgtgctcctctacgcgtctgccatgtggacccgcctcggtcttcccctccggcctccgcgcaaccacaacaatggccatggtcttccccttcaagccacccagaacccgcattccccttcggccttcccttccgtcctttgcgcaaccgccatggtcttcccctccgngcaaccacagcaaccgccatgccccta

SEQ ID NO: 79212 - DNA, 398 bp, Zea mays
  Clone ID: LIB3088-035-Q1-K1-B7
ttctggtgtctatttgcttctgagtttttttctttttatatggttgctatctcgtgggtgtcgtttggttagcatccaagccaggctattagtacgataaatgtcgtctataaacatgtgttcctacgttgccacatgctgagtcaatctgtatacatctagctctatgtggtcagcttcgtttaccacaaatagcatacatgtattgatatatcttctttgaaagcattctattaataatggttgttttctttaatatatattaataagtgctattctctctaaaataatctattcttaccttactcttttctttcttatttttaatctctttattatttttatttttattttatattattttttccttttttttacaattttttttatttttttat

SEQ ID NO: 79213 - DNA, 209 bp, Zea mays
  Clone ID: LIB3088-035-Q1-K1-B8
tgcaagttcatttacagtggataatagatgtacattgtgctggagcgttcgttagcttgggtatggtaggtgatcgagagcagtgctgtgtaatataaatatactcttgttgttcaccgtacgacgtacagttgctcttttgtagcactgatctcgtttttcattcatatgtaatctctaattcattcgtaaggctgctttcaagttcc

SEQ ID NO: 79214 - DNA, 347 bp, Zea mays
  Clone ID: LIB3088-035-Q1-K1-C1
actagttctagatcgcgagcggcctcaacttcctccacttcgaccgcgcgatgccccactgtaaccttaaggccaccaacgtgctgctggacgggctggacctgaacgcccgcgtggccgactactgcctgcaccgcctgatgacgcagtcgggcgtggcggagcagatcctggacctgggggtactgggctaccgcgcaccggagctggccgcgtccaagaagccggcgccctcgttcaaggccgacgtgtacgccttcggcgtcgcgctgctggagctcctgacgggccggtgcgccggggactgttgttcggggcccgagggcgccttcgtcttttatcttatt

SEQ ID NO: 79215 - DNA, 260 bp, Zea mays
  Clone ID: LIB3088-035-Q1-K1-C10
gactccacgcgacgggctccaagccactatggaacgaaatttaaccgaacaagcccacaagtgggaggggatcatacagagtgggccatagcaactctatctgggcgccacccgatgagccactgcgtcgcgacgcagataccgaaagcacctgctgaacgagaccatgcatgcggaaagtaagcccaaaggtgcacgagtatagctctgctgaaaaaatacatagatgcaaggactcccaacctgtgaaaccattcaag

SEQ ID NO: 79216 - DNA, 302 bp, Zea mays
  Clone ID: LIB3088-035-Q1-K1-C11
cggaagggccggctcaatccacgcgtaggagcccacctgcacagacctacgatcgaatccgagcacgaccaacacgggagagacgcttccatggatgctagcgaaacatgacggcaagcaaccgatcaagactagtctacccaggccgctagactgctccaaggtcctatacaccgtggatactggacaaattgatccagcctttggtcctcaacacacttcacaggaacacgatctaaagacaacccctgaaatctcaaaccaagcattctcagcaaagcctcaactataccatgaaaggg

SEQ ID NO: 79217 - DNA, 370 bp, Zea mays
  Clone ID: LIB3088-035-Q1-K1-C12
ccgacgcgtccgggcgaggaccatatattggtggtctaggaggaatatcgggggggggtgacatgcagatggcactttctctccgcaccatcgtattctcaacagcgccgagccacaacacgatgtactcatacaaagacgcagataggcgtcgggagtgggtcgctcatcttcaggctggtgcaggcattgatgccgacagtagcccagatgacgaacaacgtgaatgcgagaataaggctgctgcactagctcgggccatcgatcttgcagagtcagcttttgtagacacagaatagtgtgctatgggtatcgtttaggtcttgctcatgtgtcttttactcactttccgttaaaaaaagatggcatt

SEQ ID NO: 79218 - DNA, 452 bp, Zea mays
  Clone ID: LIB3088-035-Q1-K1-C2
cggacgcgtgggtgcacagagagttgcatgacataaagccactatacaaacatctgcatgcggcccaccatatttacaacaaggagaacaccttgtctccgtttgctggacttgcgtttcacccactggatggtattctgcaagcaatgccgcatgtgcttgcgctcttcctcttcccaacgcacttcaggacgcacatcgctctcgtgttcttggagggcgtgtggacgacaaacatccacgactgcattcacggcaagttatggccagtcatgggagcggggtatcacaccatccaccatacgacttaccgccacaactatggtcactacaccgtctggatggactggatgtttggtacgctccgtgagccagatgatatcctcaagaaggcctgagttcgtcgtagctgtggtttttctactgtgctggatgtgcttggtctgttctgt

SEQ ID NO: 79219 - DNA, 344 bp, Zea mays
  Clone ID: LIB3088-035-Q1-K1-C4
agcgagtgcatgagccgctgccgccagccctccgactgcggcctcctccgcgaggactatcgggagtgcctccaccactccaaggagttccagcgcaggaacaggatctacaaggaggagcaacgtcagatcagagctgctgctcgtaaggccaaggaggaagctgagggtgcccctgctgttgcagcacaccattagtctccctgtctattttttgtgttgttgttttctgttaactcatctttggttcagttatgatgctaagggcaaggcaataatctccagctgttggactacacagatttttttccccatgacttaaatatcaagactcattttgtgct

SEQ ID NO: 79220 - DNA, 294 bp, Zea mays
  Clone ID: LIB3088-035-Q1-K1-C6
cccacgcgtccgcggacgcgtgggccgtcctgacctcggctccccgggcggctgctcccgtcgcaccacacaggctttcggcaactctccgccctcgccatggccatgaccgtggcagccgcctggcttccgtcgaccgcctctcgccggagaatcttatcctctccgctccctccgttcgcggcccctatctccatccacatgccacggctggcgccgtctcccagtcccatccatcgaaagccgcgcctcttcgtcgccttcgcgcatctcgatttctccagagctattcaa

SEQ ID NO: 79221 - DNA, 369 bp, Zea mays
  Clone ID: LIB3088-035-Q1-K1-C7
cttaatcataaacttcactatcaaccagatactcacacgacatactatgaatacacttactgatgccacatctattggctcattgccatgaattcatgcatctatacatccatatataacaccttatacacaatttgtatcgaaaagctatatgtttcaccatatgctgcactactagcgtattccctaatttttaccatcaatgattcatcatactgtaacttgtactaacacttgaaccaactataggcataacaccaatcgtatctccaattcagctcttgatgccactatacaagacgtttatcaaaaagaatctcttcaaggatcacttgaagagcaaattggagatcctatattatgtacttt

SEQ ID NO: 79222 - DNA, 352 bp, Zea mays
  Clone ID: LIB3088-035-Q1-K1-C8
acgccaagagttgatgcaggaaaagagggcgaattagcaactgcttcaaggccagggggtcgatgtttctttttagaatgacaggggtgctactaatggcaaaccatggtcacagaaacaggcaacgtgcatgtaatgcactccttgcttatgtgtctttgtatgcctttaaattctttttcttttatttcttacattttatttccactttctatattttttttcctgttcttcatttttaactaattatattttttatatttttattcttttttccttttattatttattattttactttattatcttttcttttattttttttttattattctttttttttttatatact

SEQ ID NO: 79223 - DNA, 340 bp, Zea mays
  Clone ID: LIB3088-035-Q1-K1-B12
tgatcaattcacacatataggatggacacttctgacgtgcgggataccagctgattatgtggatcagcactaacatacacatattcacaacaaagatgggaatgcacctgttgaaagtgttctagcatcggataatctacccagaaggttcaagagtctttctatatggacaagagacttacatgttgtaaaacccaatctgttgcgcagttcaaggatgtacgggactacattttgtcagaatgcccgattgaactttcaactctcttatctgaggtcaaacaagaaccattcaacctttctgaccactatgaatgggttacttgtgacataaactttg

SEQ ID NO: 79224 - DNA, 361 bp, Zea mays
  Clone ID: LIB3088-035-Q1-K1-C9
gggtgcgtgggagggtccgaagctgtagagacagatgctggttctgttctgcggtgctttctactggcagcagcatcagaatcacaaacaacaatggccaacactaacttggaagatgtcccctctctggatctcatgactgagctccttcgtcgtctcacgtgctcttccaaacctgacaagcgtctaattctcattggcccacctggatctggaaaaggcacccagccaccaatcataaaagatgagtactgcttatgccacttagctactggtgatatgttaagagcagctgtcgcagctaagacccctctcggtgtcaaggctaacgaagctatggatcacggagaacttgattctg

SEQ ID NO: 79225 - DNA, 230 bp, Zea mays
  Clone ID: LIB3088-035-Q1-K1-D1
tcccacgcgtccgatgcatgcttctaccattttcacatcatacaaacaaaacaaattaaagggccttatttaaaaaatcatagggccacaaaataaacataaaaacacctattataacaaaccttatactaaacatatgcactaaaacattcttttcgcataccacatacaacattcatactttccattctcaaattatccatctaatattaaatacttactattattta

SEQ ID NO: 79226 - DNA, 409 bp, Zea mays
  Clone ID: LIB3088-035-Q1-K1-D10
cgggtcggcccactcgtgcgtcgattggtactacacctacatgctgatagctgacgaggcggaaatcggaggccaggttgctaccatctaggaggtgcgcctggtatcatgcaccaggtctactgctcccgagaacacgagcctacagacgcgctcacatgtcgagagctccgtttgccgcacaatacctcaacgacactgtgccagacacagtggactcaccatcgacagaggagtctaatgaccggagatcatccagcgcactatatatgcgaactggaactgtgggtggaattacaaaccgctagagtcatcgtgccgcctgtgggatgtgaaggattccatgcactccagtcatctggcaatcactcaaagaaattcatgattgacccattctactagcaagatt

SEQ ID NO: 79227 - DNA, 469 bp, Zea mays
  Clone ID: LIB3088-031-Q1-K1-D10
ctcggcgcgccattcccggatcgacggacgggtgcacgcgtccgagactctatcggatgagcacgaggtcaagatgtccaagatcaaggactccggtgatagaaggatcatgcggaggtcggagagatagtctcacgtcccaagggcacctgcggcaacactcatgtttagctactgctcctgctgcaactgaccagagatggctattaaattctgaggctaatccactaattctaggacctaattttggtgctctccaactctcttgctcttacataccctagctgtgacatttctgaaataacatcttacacttgtccgtgccaagatttatgtcgaaccaattttcacagatacctgctgaatgcttctgtgtaacccagttctgattgggctattttaccgtgtagatctggctcctgtaggtacaattcaagctttactgcttcaatctgccaaactagaatat

SEQ ID NO: 79228 - DNA, 413 bp, Zea mays
  Clone ID: LIB3088-031-Q1-K1-D11
gagacagcatgcctaagataaagacaagtcgtgtcaagtatcctgaaggatgggagcttagggaaccaaccatccgtgagttggatgccaaaatgagagaagctgaaaatgatccacatgatggaaagagaaagtgtgaagctctctggcctatttttcgtatttctcatcaaaggagccgctacatatatgatctttactacagaaggaaggagatatcacgggagctttatgagttttgcctggaccagagctatgcagatcgtaacctgatcgcaaagtggaaaaagccaggatacgagcgcctttgctgcctccggtgcatacagacacgtgaccacaactttgcaacgacttgtgtctgccgagtccccaagcatctgaaggaggagcaagtgatagaatgtgtccat

SEQ ID NO: 79229 - DNA, 275 bp, Zea mays
  Clone ID: LIB3088-031-Q1-K1-D12
ctgtgatggtgttggatcatttcttcagctttctggtctacttgccaagtttgcgcttgggagggaaactgcagagagcaccgtgaactcgctgtattacagatgataatagcttgtgtcatgctgtgctatcatggtaacctatgtcagataatagcgctgtcatgcgtggcttaatttctacagacgtgatgtatctctgtaagatagtgctttctgaagaaacaactatcatgtttacccagtgtggcagatctagctgttgtgcggcaccc

SEQ ID NO: 79230 - DNA, 189 bp, Zea mays
  Clone ID: LIB3088-031-Q1-K1-D2
caaagagcgtgctcatcccatccacaatcagtaatccgcactctacagtttgctcataggttaccctggcaactggatgttctgtgttcaatttcagttacttttgaactgtaaggtctgttattactagtttcccagaacttatatgctcacgtgcgctttatttcaatgtctattttgtgatgtgtc

SEQ ID NO: 79231 - DNA, 294 bp, Zea mays
  Clone ID: LIB3088-031-Q1-K1-D3
cggacgcgtgggcggacgcgtgggtttcgcatagaaagttgatcatagcaggcctgtggcggccttctctggcatgtaatataagtcaaagttgtcccacttgaagctctggtctttttgtccttggactttggtttgcgttctggtgaggtagtagttggtatgttcgggcttcaatcctagatgtcatgaaactgttgtaatttcattgcttcagtaatgaactttggattggtccgctgtgaaaaagtacccaaccctcttggtgtgtatgtttcagctctaaaaaagcat

SEQ ID NO: 79232 - DNA, 461 bp, Zea mays
  Clone ID: LIB3088-031-Q1-K1-D4
cgcttgataagattttgaacaccctcaaatctgctcaaaggaaatcccaggtgatgcatgagcatgagcgtgatgcagtaacagcaaaccaagatggaaaaggctctaggaaggcaaaaaagagagcacaactcagcaagaatggccaaatcagttcactgagtggctgcttcacttgccatgctttctgatacatgtaattccaaaattgagaatcaggatccgacaaattccttcgcattccatgcaccaccttcatgttccccacatcaaaatctgggtgaagttcggagatccatcacatatcagtacataatatgatgatcccacagctggagattagacagagatctttcgaagatgctagctgcaggctccagctgctatgatagggacaatgccaaggggacaaataaaatgcagcacgaaggaaaagatgaacagtacttggtacaccccat

SEQ ID NO: 79233 - DNA, 181 bp, Zea mays
  Clone ID: LIB3088-031-Q1-K1-D5
acgcacacgtggacgcacgcgcggactcctgatggcaaactagtcataaactgacctccagcatccaggggagacatgctatataagtcgaaaatcacccacttgaatctctagagcatatgtgcacagactttgctttgcgttgtgctaaggtactagccaggtatggcacgggattcaa

SEQ ID NO: 79234 - DNA, 357 bp, Zea mays
  Clone ID: LIB3088-031-Q1-K1-D6
tcggaaggagaagctgggcacgattgacccctactttgtcaagctcggtgacgccgtggtcacctggatcgaggcctgggatgagctgaacccgtcgacccctgccgtcgcaaatggcaaggccaagtagatgtgccatcacttcggcactggagtgaaaaagaaagtatgattgggtcctgcctaggccccatagatatagctcttttttgagaaggaagagagattaattcagcagcagcttttataaattctttgttgtcatgaagcaggtggttcttttgtagttgatgaaagggatttgtcggcgctatcgtttacataattcagacaatgttttatattgggtaattctga

SEQ ID NO: 79235 - DNA, 98 bp, Zea mays
  Clone ID: LIB3088-031-Q1-K1-D7
gcgtccacgcatgcggcgcctcaccttatacatttagctcatacgcacacttcagggctctgagatgacatgtcatggagaatacaatatacacactt

SEQ ID NO: 79236 - DNA, 167 bp, Zea mays
  Clone ID: LIB3088-031-Q1-K1-D9
attcgttcacacgtattaactaataccttctgcatatgaacttgaaagcttaacttagtcatatgggctcatagtcataggtctatagtcataagattaatgtaaatcaatttctataccattatctaatctatgaacatttatttacattattttatcttctaaac

SEQ ID NO: 79237 - DNA, 435 bp, Zea mays
  Clone ID: LIB3088-031-Q1-K1-E10
cacatccccaattccccaggaactggctcgtaatttttccactgccatcgcaccctttcggggaaccctaaacccgggaccggggtttatcggtgaggcgagccgcgagtggaactgtggaagcgtcgagcttttttcttctttgtcttgctgcgcaagaagaagggaaacgagaggagggcggcgatggcgaagaggctgctcccgtcgctgaaccgggtgctggtggagaagctggtgcagcccaagaagaccgccggcggcatcctcctcccggaaacatccaagcagctgaatgctgctaaagtggtggctgttggccctggtgagcgcgacaaggcaggcaatctgatcccagttgctctgaaggaaggcgacacttgtcttctgcccgagtatggtggatctgaaatcaaacttgcggctgataaagag

SEQ ID NO: 79238 - DNA, 446 bp, Zea mays
  Clone ID: LIB3088-031-Q1-K1-E11
ccagccggtcggccaacggctgctgcggcggcagcgccatacgcggacaggcggctgcgggtgaacccaaatgcggatcacaagccggaagactacagcgacgtgcgcggcgagtacgcgccggccgtgtacagcgcactcgagcggcatctcccacccagcctcatcgatgccgaccgcgatgtcaagctacacttcatgcgggacattctcgcgcgctactggccgcagggcgagcgtaacaaggtgcaaaggcacagagaatataggcagaggatactccacctttacaagcctcttcatgaagaattatacaatatgcatccttcagtgttcttcttaccaacattccttgaagcagttaggagcaatacagaagaatgctttagaagtattatgactgagccaattcctggtgtttattcgtttgctatgttgcagcctac

SEQ ID NO: 79239 - DNA, 153 bp, Zea mays
  Clone ID: LIB3088-031-Q1-K1-E3
gcgcgcacgcgtggactgcgacgccacaccagtgcccaattgcattgattcctactcggtccctacatggtgcctacaatggatgtcgtcgggcccgatcactccgacttctgtgccaagcctgccaccaacgggtaggcccagtccggcgcc

SEQ ID NO: 79240 - DNA, 441 bp, Zea mays
  Clone ID: LIB3088-031-Q1-K1-E4
gcgctcgagtcgagggagctgactcagaggaacctgaagctggaagctgagctgcgtgccttggaacccctcatgcaagacgctctgcatctgcgatctgaagcaagtaaactgcagtctctgaggcaagagttggctgcgaaggttcaaggcctatcaaaagagcttgaacttcagaagtctgaaagccagaaaatgactgctttggtagctgaacgtgatgcgctgtgtcaagaactgctccaggctagggcgaaccttgagtttgagaagaaggcgaagccagagctgactgcgcaggttcaggcaatggagaaggatcttgtggctatggctcatgaggcggagaagctgagggctgatatcgcggagagaaacacacctactaggttcagcagccgtggaacgtatggagcctcgttgtcgactcctgggatgggt

SEQ ID NO: 79241 - DNA, 159 bp, Zea mays
  Clone ID: LIB3088-031-Q1-K1-E5
gtcgctggacaaccctttggtggccatggagtgcttcatcttcctgtagcactaaccttgtcctgacccgttctgcgctgtgagcaaattactccacatagttttagcaggagtaaaggtggtggtgttggtagcagcagcaggcagtaggccagtagc

SEQ ID NO: 79242 - DNA, 370 bp, Zea mays
  Clone ID: LIB3088-031-Q1-K1-C9
gtcctcagtccctcacacactcactatacactgctctgctgcagcatgaaggaagaagctggcgcctccctagcgctcgttggcagcaatggccaccaccgctgcgtccagcctcctcaagtcctccttcgcgggctcccggctcccttcggccacgcgcaccaccaccccgtcgtccgtggccggggccaccccgcgcgccggcagcggccccatccgcgcgtccatctcctgccccaacccgccctacgacctgacgtccttccggatcagccccatcaaggagtccatcgtgtcccgcgagatgacccggcgctacatgacggacatgatcacccacgccgacaccgacgtggtgatcgtgggcgcc

SEQ ID NO: 79243 - DNA, 421 bp, Zea mays
  Clone ID: LIB3088-031-Q1-K1-E6
gtgagctcagatgtgttcctttgtcttgaaaacaagtacagcaagctggttctgtggtcgaaatccgacaggaaacttctgtttgatcttgtgaactcaattttggctgacatgaccattccagacattggcttgtgttcaaagctcatgatgaagcgctggcctgaaatagatcacggacagttaactgaaatcgtcaggcaaatggtgcagaagcgaagtaactgtgggcactttttcttggaggatgttcagcctttgccattggaccatggttctgaggtagagctggttggaacgaagattgccatgatgatccatgatgacattatgacagattttatcgtcggaatcatgtcctaggagaacctccttgttatcagctaatgtttaagggctgtagttgtttagctagattgtt

SEQ ID NO: 79244 - DNA, 374 bp, Zea mays
  Clone ID: LIB3088-031-Q1-K1-E7
gcgactccgcggcctcgatcagagtcggaggcgaacacccccatggcggcggctggcgggggcgcatgagggaaggtatcgttcaagatcatcctcacctccgaccccaagctccctttcaaagtgttcagcgtgcccgaggcggcgccctttaccgcggtgctcaagtactccgcggaggagttcaaggtcccgtcccagaccaggcgccatcatcaccaacgatggaattggcatcaacccccagcaaagtgcatgcaacgtgtttctgaaacatggttcggagctgcgtctcatccctcgcgatagggttggagctgtaatcatgtcttccggttagaggatatatacagtccaatgcataatgagcaaaa

SEQ ID NO: 79245 - DNA, 226 bp, Zea mays
  Clone ID: LIB3088-031-Q1-K1-E8
ttcattgagcttgactggcggcacccctaggatcaagatcgagctatgtaactcgagcagggggagacgtaagcccgctggcgctatatcaaggactaccaatccatggccttctctctcaacatatccattgagtaagctctcgaagattatgacaacgatgaactctagcattttttaagctagaacctcatttttcttatctcacagcgatgggttctccatt

SEQ ID NO: 79246 - DNA, 135 bp, Zea mays
  Clone ID: LIB3088-031-Q1-K1-B1
agatcagtctataactgatactttcaaagtttctatcgtgatcaatagcactccctttttaagacacagcacacggacttttgattatgaaacatctagtactttcattaatttatattctatacaaacctacta

SEQ ID NO: 79247 - DNA, 453 bp, Zea mays
  Clone ID: LIB3088-031-Q1-K1-B10
tcgcggacgcgtgggtttgcagatgtgaaggacataaagtgtgtgataaattatgattttccagcaactcttgaagattatattcacaggataggtcgaactggccgtgctggtgctagcggaactgcatttacttttttcacacacgcaaatgcaaagttctcaaggaatctagtgaagattctgcgagaagctggccaagttgtgaatcctgccttagaatccatgtccaggtcttcgaactcaacgggaggaggcaattttcggtcgagaggcagaggtgggtttggtaaccggggccatatgtctggatcaaatacctttcctttaggaggaagaaggccatattgatgtgtgcaaaagaactgtgggagtatgggactatttgtatactactcggcattaagtgcattctttgggaaatttctgagaaattttccctactaccaggat

SEQ ID NO: 79248 - DNA, 345 bp, Zea mays
  Clone ID: LIB3088-031-Q1-K1-B12
gcgcgcacgcgtagactgactcgtgtttccagtctctcctcataatttcagcagagaggtatgagcgatgttcaatgggggagatgtccacattagtttcagtgtcacaaatggatatttgtgatctattatagtctctcttgtgtagtttgttgtacattgatcgattattgaatccaatagtcccggattactcctgttagaatcatgtatcacacatgtagtaatacttatcttagttctacataatttgatttaccctaattcatttttaaaatatgatgcgacattctatgtataacggattgagtacttaggatgtgccctattgtttacaatacaaca

SEQ ID NO: 79249 - DNA, 344 bp, Zea mays
  Clone ID: LIB3088-031-Q1-K1-B2
acaaaagtggcacagatgaggaatctttcaaaccactacttcagatggttgtcactattaaaaaaccagaaggtccaatcctagaatttgactgcaactttaatgatgatgaactaacaattgaaaatatgagggcgctgaaccgtgataaccccgatgctaagaatgtgtatgaggggccacaattttcggacctggataagagcttgcagaaggccttgcacaggtaccttgaggtcagggggttcaaacattcactacatgattggctgtacgaatacatgatgagaaaggatgagaaggagtatgttgtttggctgaagagcatgaaggagttcatcggc

SEQ ID NO: 79250 - DNA, 320 bp, Zea mays
  Clone ID: LIB3088-031-Q1-K1-B3
acgcattcttgccgtgacatatgccacctgtcgggctgagccctactcgcactcctctgaggcctcactggccatggcgatccggacgagcaacaacgtgatcggctcgctgaacctggcgacactcctgctctcggtccccatcctcgtctcgggaatctggctgcggtcgcgcgcctacggctccgagtgcgaccacctactgtccaccccgtccatcgcgctgggcgcggtgctcatggccatcgctgtcgcgggcctcgccggcgcctgcttccgcgccacctgtctgctatggctctaccttctcaccatgctcg

SEQ ID NO: 79251 - DNA, 187 bp, Zea mays
  Clone ID: LIB3088-031-Q1-K1-B4
ggcggcggccaaggaggccaagtcgcccaagaaggccgctaagtcccccaagaaggcatagaggggcgcctttaccgctgtgatgttgaatgctcgtgttcagtagatctttacttctgtagtgtcgtcgttgttattggaactggttagtagatctgtgcattgtggttgaaaaaaaataagtaag

SEQ ID NO: 79252 - DNA, 222 bp, Zea mays
  Clone ID: LIB3088-031-Q1-K1-B5
tcgtaccggtgcgccatgtccgaattgacggatggacccacgcattcgcacccttctacacaccagcagtttagctgagcacgacacaaagccgtctggggccgactggccatggcgatccggatgagcaacaacgtgatcggcgcgctgaacctggtgacactcctgctttcggtccccatcctcgtctcgggaatctggctgcggtcgcgcgcctactgg

SEQ ID NO: 79253 - DNA, 370 bp, Zea mays
  Clone ID: LIB3088-031-Q1-K1-B6
cggacgcgtgggcggacgcgtgggaccagatcttctttctcatgcctcaggcgacagcggtcatgtcgaggcgttgagagtatatcttctgtcaaaatctctatccagattgaagaaccagttccaaagtggaaatggcgtgattacggtcgactgcatcgaaggttatccactaatcaggttacagctaggaaagcatgtttttctaagtgcaggggatttgtatctggctagtcgatcctaatttttgtgtgcagcatcccaattttgactgattcacccatcattttgccgcaatcggcttaaacagcttggttccatttatgcattcatattcacttggtaaaggtgaaaaattccaatttatgat

SEQ ID NO: 79254 - DNA, 203 bp, Zea mays
  Clone ID: LIB3088-031-Q1-K1-B7
gcgcacattcttgaggagacatatgaacaatcaaggatgggtacctattgacctaatcttagggttcaagcggatgagggcgtgtacaggtttggtggacaccaactacatactagatgctatccgtggttctgagttattggaagtgcagggagataatgtccggaggcgcaatgattggatggaatgggtgcttcattaag

SEQ ID NO: 79255 - DNA, 284 bp, Zea mays
  Clone ID: LIB3088-031-Q1-K1-B9
attcgtgagcagctatgtgtatgcatgttgtctacttacaaacttatatctggtttgaggtccatggggatcaactaatgggtctgggaatttatattatgatgttgacgataaaaataaaaaattactattaaaatataattaaataaaaaaaataaaatataaaaaataataatataactaatttataattaaaatataataacaaaaatacaaataaaatttaaaaataataatatattaattatttaatttaaattataataatttaaaacttttatttt

SEQ ID NO: 79256 - DNA, 192 bp, Zea mays
  Clone ID: LIB3088-031-Q1-K1-C1
ctttcacgttaggaaaatgtgtacatggcgaatctcgactagcactgctcttagggaccaggcgatcgatgagttcatcaagattgttgcccacactgctcactctgaagaccttactgtggtctaacgaatcctaatgtctggggcgatacatgaccgaagcggcatccattggactgttgggtgcttcat

SEQ ID NO: 79257 - DNA, 451 bp, Zea mays
  Clone ID: LIB3088-031-Q1-K1-C11
atcacaagcaaaagcaacaaggcagcagcacaagcaagaaccacacctactcccttcgccggtgatcatgtcgtcttgctgcggcggcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgaggcggtcaccgagggcggcggctgcgactgcaacacctgcaagtgcggcaccagctgcggctgctcctgctgcagctgcaactgagccggcccggctcggcgatggcgcacgagagtcgagaggacgacgacgaggaggcgtataataaatataatagcggcgtccagtaaataagatcctgtcaactgcacccgccattatccatggtcgctcgct

SEQ ID NO: 79258 - DNA, 268 bp, Zea mays
  Clone ID: LIB3088-031-Q1-K1-C2
cccacgcgttcgggccaaggtggacgacagcttcttcatcgcggcggggctggcggtgccggtggcggccgtcatcggcaagagggccagcgggcagatcccctacgtgaagagcgtgaggctggacctggtccccaacgtcgtgttcgtgccgttcgtgacgctgctcggcatcatcggcgccaccgcgtggcaaatgagcagcaagagcgctaccgcccaggatgacgaggactccaactaggaggagaagaagaaggagacgatg

SEQ ID NO: 79259 - DNA, 327 bp, Zea mays
  Clone ID: LIB3088-031-Q1-K1-C3
gtaaaaaaggcgtgcaactttgacgttaactccagctactgccggtcctgcatttaagggcatgcgtgtatttttatactatgttccagcaagtgtgtgtattttttatataccatctaatttttgttgtctgctagtttacttttaaactatagcacgataaataaaaaagaatggagatggtatatatgatctagctaaggccttgttcggttattaattgtcctattccatatgtattagatgggattggaaaaaattatgaataatgttcacttgtttggattataaacaaactcaatcttgttcaatccatatggattgaga

SEQ ID NO: 79260 - DNA, 321 bp, Zea mays
  Clone ID: LIB3088-031-Q1-K1-C4
gatccatggggtgttcccgatgactacgaatgtgaggtgattgaagacgacaccccaatggctaaggatgttcctcagcaccggcctgttgctcttcctgaggagttcttcaaggcactagatgctgtcaaatctgatcctgctcttcaaggcgatgctcctcctcaagtgaaagcgtagggatggctgttcctggctaacgtcatttcacattttgccgcggtgggtatggactggtttcttgtgtcatttgccagcaatgcgcttgctctgagcagaataaatttctggtgagtaccatcaaagtgtgaatttgaactt

SEQ ID NO: 79261 - DNA, 294 bp, Zea mays
  Clone ID: LIB3088-031-Q1-K1-C6
acgctgacgcgtgggcggacgcctggtacctggagtgccaattactcctatgtatgtataagggatattattagagatgtgcttgagaagcagggagctgacttctcagtctgccttatgtctttgacatgtcatcgtagagtacaccagagtgggtgtaatagatgaagccttatgcttgaccaaatacccttgtccattttaaaagtgcctgcactatgctggtcgctagtcgcatgtttatcatcatgcggcaacatgtgggagacttgatgcttcatggtatatataata

SEQ ID NO: 79262 - DNA, 292 bp, Zea mays
  Clone ID: LIB3088-031-Q1-K1-A9
ccgacgcgtgggctcacgctttccgacatctcaacaccacatagctctttacatcttacgggtgtccgctcatgcgcagtccgagaaccctgtaaatctcttcaaccgctggaccttcgactatgtccaagggaacgatttatccctgaacgactacctggactgaactgcgagctagcacgctacattccagactcacttcgacctgacctactgcaagatgcgaatactgaaggctcaacgcgccctctgcgatcgcctcaccaactcgctcatgatgcacggactcaac

SEQ ID NO: 79263 - DNA, 331 bp, Zea mays
  Clone ID: LIB3088-031-Q1-K1-C7
ataatatgccgcaaccctagcttccgatctcaattgcgaaccctcgcgtgttcttcggcatgacggtctgcggtgcccctgctggccggatcgtgatggatctgtacgccaaccaggtgcccaagactcgtgagaacttgcgcgcgctgtgcacgggccataagggcgtgggcaagtccgggaagccgtttcactacaagggcttcaccttgcaccgtgtcatacccgagttcatgtgccatggcagatactttacccgcggcaactgcaccggctgcgagtgcatctacggtgagaagtttcccgactagaagttcgagcgcaagcacac

SEQ ID NO: 79264 - DNA, 325 bp, Zea mays
  Clone ID: LIB3088-031-Q1-K1-C8
cggactcgtgggttctaggaggacatgttataatgcttggcgcaaatccttcaagccagggtgctgcactggaggcgactacgtgcatatcctggtggtttgcaagttggaggtgggataaatttggagaatgcaatgtcttaccttaatgaatgggccagtcatgtgatattgacctcttatgtgtttagtgatggcaagatgaacactgaaaggttaagaaaacttgtcgagctggttgggaaacagaggctcgtgctggaccttagttgtcgaaaaaaagttatgaattgatgatgaacttgtggaactatttgggcactat

SEQ ID NO: 79265 - DNA, 369 bp, Zea mays
  Clone ID: LIB3088-030-Q1-K1-F9
gaatacccggcgcgacccactcttccgaattataataaaaaaatttaaaaattaatataatttaaacaaaaaaaaaaaaaaaatgttatttttattttgaaaaagaacactgcccccctctcccctccaaaccccccatcctacttactatcccctcttttcctcccctcaccttaatttaccacttttttttttttttcacccttatttaaaaacctctttattttctaaacccatttccttcccaaaacactcccctttccccactcttactccttttccaacatcccctctctctattccctctccaccattttctctctccccccccccttttttccctcccccctttttcgtccccttattttc

SEQ ID NO: 79266 - DNA, 441 bp, Zea mays
  unsure at all n locations
  Clone ID: LIB3088-030-Q1-K1-G1
gcgagctggtgagatggatcggttggaggagcgtttcattaannaaggggagagggagatggaggatgctcgcaggggagaggagcggaaggaggatgctgttgacaggaatacccatgagccgcagcaaggtcaaggcctcatcctctcactcgccaacggcagcgacagcggcaggtctggaatgttgccgatgtcgaacccttcagctaatcccacacagcttacaattttctatggtggatcagtatgtgtgtatgactcggtgccaccagaaaaggctcaggcaatcatgcttatagctgcggctgcagcagctgcggcagccaccaaatgcagtgctgccactgcttttaatcctccaatgagcacttttgtagcagctggacaagctcangttgttgctgaccctagctcaataagcaagcttcaggctgatct

SEQ ID NO: 79267 - DNA, 148 bp, Zea mays
  unsure at all n locations
  Clone ID: LIB3088-030-Q1-K1-G12
ccctccccttaacccttggcaaaattaaaaaaacagggnntaaaccggggaccggggaaaaagaaaaaggagacnngggaacccaaaataaaaaaaaacgggccggccccttaaaagaaccaaaattaccttccccgtcattccaacc

SEQ ID NO: 79268 - DNA, 396 bp, Zea mays
  Clone ID: LIB3088-030-Q1-K1-G2
ccctaccaccacaccaaaatggttctggcagggccatcaaaaaagggttgggggattcaggcaccgaagcaggagcatcaacagcttctcaacaagattcaagccatgattcaccgcatgggcagtcttcgacagccaaagcggacatggaaatcgatggttgatttgtaggttccaaaatggcaagaaagggaatcccctctaatcattatgtatactgtggtcagaatgtccgctatatattgtaacatcaaaaaaagcacctccaggcctgagggtgttactgctaatgcgtttggtttacttgtccttgtaatatgcatacacatttagaactcatgcagccattgtgtgtgctcgaaccggtggatcgcttgccttgtgtgttgtactact

SEQ ID NO: 79269 - DNA, 344 bp, Zea mays
  unsure at all n locations
  Clone ID: LIB3088-030-Q1-K1-G3
gcgcccacgcgtnncgccacgcgtnccgcgtgcgaaaggcttgacccaacaacaacaacaacagcagcggtggcgccttttgaagcttgacgggatgccgctgtcccccaacgtggtgcgcgtggccaccgtgctcaacgagaaggggctcgacttcgagatcgtccccgtcgacctcaccaccggcgcccacaagcagnccgactttctcaccctcaaccctttcggncagatcccggctctcgtcgacggagacgaagtcctcttcgagtcccgtgcgatcaaccggtacatcgccagcaagtacgcgtcggagggcacggacctgctccccgcgacggcgt

SEQ ID NO: 79270 - DNA, 438 bp, Zea mays
  unsure at all n locations
  Clone ID: LIB3088-030-Q1-K1-G4
tgatagagaccctggagctggaaaatgttttgataaacgcatgcataactatgtgttcggcanatgctcggagggagagcagaggagctcatgctcgtgaagatttcacgaccagagatgacgagaagtggatgaaacactcactgggatactgggagaacgagaaggttcgattggcatacaggccggtgcacatgaacacattggacgatgaagtagagtcattcccgccaaaagcacgtgtctattgatcgattcaagcctaacacctcgggaattccatgtaaggtgttaataaagcagatgtgcgttcctggctgagaacatgacctggattagtgtccctcattttctgtgtttctgtattctgcctaagttgctagaaataaagggtacgatagaacacatgctaaatcctggctgatgtttgtgtacatg

SEQ ID NO: 79271 - DNA, 374 bp, Zea mays
  unsure at all n locations
  Clone ID: LIB3088-030-Q1-K1-G7
ctcggaatggaagccatcaaggaaatgtttgggttaagcttcacattgaaccaacgagcgatcctaagacctgtggagctgggttagtgctaactcctaaagcaagcatcgagacaaattatgattatgatggttgatagttgcatgggacaacaaacaatgccatgatgaaatacatagtagaggagacctcttgtcagtcacccatacgagcattgattttcactgatgcccctgtatatttcgtatcacttattatgtagatgtacatgtgatggattttgcattgtggaactgttaaaatgaaccgacatgagatgccaaatctttgcnccnnannaaaataaantaataataaaaattatatatttttt

SEQ ID NO: 79272 - DNA, 471 bp, Zea mays
  unsure at all n locations
  Clone ID: LIB3088-030-Q1-K1-G8
tcttcctcccacgcgtccgaaaaaaaaaaaaaaaattttaaaaaaaaaaaaaaaaaaaaaaataaattgtaaaatttaaaaagaagaaggggaaaaaaataaaaaattaatangttttttatattttcaatttttcctttcttttttttccatccttacacctcttccatttttctttttaaactcctttaactaacccccttttcccatcttttcaccttctaaatccttaaaccttccaatttacccctttttcccctttccccctttccccttttgccctttttcttttttattctccgactcttctccttttcccactttttaccattcttttatctttattttcactctcccttttcccctttttttttccccttttttcctctgttttgttactcctttccttcccctttttattttttcactttcctagcgcccctttcccttttctttttttccctttttttc

SEQ ID NO: 79273 - DNA, 110 bp, Zea mays
  Clone ID: LIB3088-030-Q1-K1-H3
tacctaaattactcttatttgacacatcttaacaccatcaaaactcccaaaaccacttcattaccatactccatactcttaactatattaccgttttttccatactacac

SEQ ID NO: 79274 - DNA, 274 bp, Zea mays
  Clone ID: LIB3088-030-Q1-K1-H4
gcactcgatctgatagagctgttccaagagaacgcatcagtagcctgtgagccacgccgcagggcgggcgtcaagaggcacaccgaccctggcttcttcaccatcctcctgcaggacggcatggtcggcctgcatgtgctcctcgtcaacaacaggcagagcggcggctgctgggtggacatcgctccccggcctggggcgctcatggtcaacatcagtgatcttctgcagctcgtgaccaatgaccggctcatgagcgtggagcaccgggtgc

SEQ ID NO: 79275 - DNA, 204 bp, Zea mays
  unsure at all n locations
  Clone ID: LIB3088-030-Q1-K1-H5
ngcgnggacgcgtgggcggacgtttgggcggactcgtgggtctgtttggataagggggatggagtccaaatgcttaggatttagtgcaactttgaactaaatttctagagcaacccccttatttgagcacccatgtatgagccagattatgtgattccctgtaccatcaaccagttgactaataaatactcacctgttgcctgt

SEQ ID NO: 79276 - DNA, 210 bp, Zea mays
  unsure at all n locations
  Clone ID: LIB3088-030-Q1-K1-H7
tataactccattctctactctatctataactctaacggcaaggatctcaacgtccgtatgttcacctttgaccagacccagtgcctcttctttctcnttttcttctgcatctactttatcttatctactcttctattaaccaaattatgttattcccttctccttttttcattttacttactaatacttacctttttttctattaaaatt

SEQ ID NO: 79277 - DNA, 438 bp, Zea mays
  unsure at all n locations
  Clone ID: LIB3088-030-Q1-K1-H9
cagagatgtgaccgttgagaaatctcatcccgctgttgccgctgcttcagacaacagggaggttagcaaaaacagttgcagaatatttggcatatctttgaccgagaaggttccagcaatgaaagaaaagggctgtggtgacatcaacaccaactatccatcccccttcctgtctttgaagcaacaagtgccgaaatcgctgggcaacagctgtgccaccgttcatgagcagaagcctgttgttgctagggtgattgacgtttcaacagtggatatgatgatctgatgtattggaaaactgtcctggaggctgtgttgcgtagtgtggacagtgtcngtttgatggttcggtatcgtgaagacgggatttgattgaggatctggccagatntgtatcctagttgtagctggtagagcactttgtatgacaaccgtgag

SEQ ID NO: 79278 - DNA, 373 bp, Zea mays
  unsure at all n locations
  Clone ID: LIB3088-031-Q1-K1-A10
ggtccgggatcgacggatggatccacgcgtacagttgatctcatntgttactgatgatctaaggttacatgctcccctaaacgacggggtaaaggagttacagaccaacctgattgcttaccagaggatccactttatgctctcctcctactgcacacgacgatctcttctgcgaaagcctttcacgagcagctgtatgtggcggacatcaccagcagcgcgttcgagccggcttgcatgatgggcaagtgcgacccactgcacggcaagtacatggcttgctgcctgatgtaccgcggcgacttggcgcccaaggacgtgaacgccatggtggccaccattcaatacgaatcgcaccatccaattcgtggac

SEQ ID NO: 79279 - DNA, 352 bp, Zea mays
  Clone ID: LIB3088-031-Q1-K1-A11
tcgattgccttaggattcctatcaccaatggacgtctcaacatgggaacttggcagggtatttggctctgtgaacatcgagattatgctactcctcgacagattgtgatcacgctgaatgggatctagcctaaggtgatctatgttaagagctggaaatgcaatgcagcgacttcgacatgtttaaatcagatgcactgaaactgaaactgtctatggcccagttgtgataggcgttccagtggagaatgttatttgtaatatgatgctagcatgaggggaacaaaatctcttaacgagcttattctcatgttgagcttgtttagctatcttgggtggtttaaaaaatatta

SEQ ID NO: 79280 - DNA, 327 bp, Zea mays
  Clone ID: LIB3088-031-Q1-K1-A2
gggacatgaaggagaagctcgcctacattgccctggactacgaccaggagatggagactgccaagaccagctcttctgttgagaagagctacgagctgcctgacggacaggtcatcaccattggtgctgagcgcttccgctgccctgaggtcctcttccagccatccttcattgggatggaagctgctggtatccacgagaccacctacaactccatcatgaagtgcgacgtggatattatgaaggatctgtatggcaacatcgtcctctccggaggtaccactatgttccctggcattgctgacaggatgagcaaggaaatcaccg

SEQ ID NO: 79281 - DNA, 384 bp, Zea mays
  Clone ID: LIB3088-031-Q1-K1-A4
accacgcgtacgagaaaaaagcattagtgaatttaaagaaagctgcaaaggttggtgcttggccaagtgcatatacagcttgctgcgaaggccttgcccatcacaggaactaaagctgaccttccaaaaaaatctagaaaagaggatcttgagagtgttgctggcatggcttcgtcagcaacagcaagcggtgggaagtttgacgagaagttgcctggctagaaacctgcaaagcaccctggcgaacatagaaagctcctcccacttgctgaggggaagggaatggtcagccttgagaaacagcagaatgacaaaattctgagctctctacttgccaaaaactctgatgaaccggttgatgtcatcaaggcaattacaatgtac

SEQ ID NO: 79282 - DNA, 169 bp, Zea mays
  Clone ID: LIB3088-031-Q1-K1-A7
atgacttgaactctacatggtttacgcgggataaacatagaacctgaatcatgtgctgcagtgccgcacattcgaaaatgtaacccctactacaaaaaaaaatacatatcctatactaaaactattaacctagagtaaaattatagccaaacaaccttaaaagggcggc

SEQ ID NO: 79283 - DNA, 398 bp, Zea mays
  Clone ID: LIB3088-030-Q1-K1-F8
gcgcgtcgtctgcgaccccttcagggacggtgtcgaacaggggcctcagatcgggggcgggcaattcagcaagatcgggcggtacgttcagtccggcgtcgacagcggtgccaccctcgtcgccggcggcgacagggtaggcgacaggggcttctacatacagccgacggtgtttgccgacgccaaggacgaaatgaagatcgctcgggaggagatattcgggccggtgcaaaccattctcaagttcagcggcgtggaggaggtgatccggcgcgcgaacgcgacgccctacgggctggcggcgggggtgttcacgcggagcctgtacgcggccaacaccctgtcgcgggcgctgcgggcgggcaccgtgtgggtgaactgctacgacgtgttcgacg

SEQ ID NO: 79284 - DNA, 426 bp, Zea mays
  Clone ID: LIB3088-031-Q1-K1-A8
ggagcccaaatttctcaagaacggtgatgctggtatggtgaagatggttcccactaagcccatggtggtggagaccttttgtgagtatcctcctcttggtcgatttgctgtccgtgacatgaggcaaacggtggctgtcggagtcatcaagagtgtggagaagaaggacccaactggagccaaggtgacgaatgctgctgccaagaagaaatgatctatctggctggtgactaaagctgctgccaagaagaaatgatctatctggctggtgctgtgcttgcttgttggttacctcgtggaagcttaaaatatctcggcttgttgacatccttgcagttgtcgcgtgaacaagtaatctatgatggcaatggttgcctgggaatgaagtattattactttcggtgaaaccgtgatgctattaagact

SEQ ID NO: 79285 - DNA, 340 bp, Zea mays
  Clone ID: LIB3088-002-Q1-K1-A10
cccacgcgtccggtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttacagcgcctggtccgtgagatcgctcatgacttcaagacggatctgcggttccagagccacgc

SEQ ID NO: 79286 - DNA, 249 bp, Zea mays
  Clone ID: LIB3088-002-Q1-K1-A12
gtttttcgtagatgactcgcggtcacggcaatatttgtgatattgtgtcatctgtggactatggttaaatttcagttatttgttttctttcaccttccagaactgttagcaagagcattctggaccaggatgctcgaacacaactggctgtatgtacatttgtgaatggtgaataaagaaggggtaataaactgctgcgaaataaaaaaaaaaaaaataaaaaaaaaaaataaaaaaaaaagaattaaa

SEQ ID NO: 79287 - DNA, 371 bp, Zea mays
  unsure at all n locations
  Clone ID: LIB3088-002-Q1-K1-A2
aggacgcgtgggaaaagagatgatgcagctacagcacgaagcagtagccagctgaacatgctagacatgttattgcggatggtcaaggctcatgattcagagcagaagatgcacataaatactggtgaatgatgccatcgacgatgatgaattgatgaaacgatggatgatgtcatcgatgaaagatggaatggaactcaaattttggtggtcgcacaagtgtggagacataaatttatatatacttagttaggctcaatgttagcacaaacagttgatgagcaagtttaaatttagagtacacttatgtatgagttatntgacaatgcttatttatgagatattgaatgatatttatctatattatattg

SEQ ID NO: 79288 - DNA, 328 bp, Zea mays
  Clone ID: LIB3088-002-Q1-K1-A3
atcaaggtgaagatcatgcttgactgggacccgaacggcaaggttggcccgatcactcctcttgcggacctggtgaccatccacaccccgaaggacgaggacgagccgcgccctccggtcttggcacctgctgaggtgtaaggtcccaactgtgtccttgaaatggcagtttgatcgggtcctagataggtttctatcttacgataaggacaatgctaaggcagttggttaccttaatctttatggacagatgctatgtgttgcttctgcggcacttttgtttaagctaagttttgcggagacaagatacttatatatgttcccgatg

SEQ ID NO: 79289 - DNA, 324 bp, Zea mays
  Clone ID: LIB3088-002-Q1-K1-A4
gattgctacagagacatgcatctggcttgagctggcttttgctatggcaaacacaggtgcagggatcgctgggtgttgcaccgtgtctgcattatctgtggttacattctggaccctgtattttctatggttgtatgcccactactgtttagtattaattatcaataaatttgtttgggacggttgaattgcatgcattgcatgacgtttcttgttggttatttgttttctcttgccatgcttacagtattggtgttggcaatttaatcgtgatttttttgtacctgtttcgaaaattggtgggcagcttacccgcgcttgtgc

SEQ ID NO: 79290 - DNA, 338 bp, Zea mays
  Clone ID: LIB3088-002-Q1-K1-A5
accacgcgtccgtccacgcgtccggtttttggtagaccacccaggaggtgatgatgttctgatgaccttaactggcaaggatgcgactgatgatttcgaggatgtcggtcacagcaacactggccgcgcaatgatggatgagtacttggtgggtgaaatcgacgcgtcaacgatcccttccaggacgaagtatgtgcccccgaaacaacctcactacatccaggacaagactaccgagtttggcatcaagatccttcagttttcgggtcctctggcaattctgggcttagctgttgccgataggatgtacaccaagtccgagtctgcttaactttgtt

SEQ ID NO: 79291 - DNA, 310 bp, Zea mays
  Clone ID: LIB3088-002-Q1-K1-A6
cccaagtgtcagtcgacgaatctggaatgctaagattgcaagaaaggcctatgtcgcgctagccagagaggcatcgagcgcacaagtgtgtacaggcagatgtatgcatatggctaccaacaggtgcatccataagcgccccaagacgagccacgagcagcgcacgcgtgccgaccagcagcagccgacgcttcgcaggttcccgaagcagatgcggggcccctacacgaaggcgatcctgtagctcgtgaggtatagaaccctctagctcgccacttttgactagcacgaacacgcgcgtagggtctac

SEQ ID NO: 79292 - DNA, 116 bp, Zea mays
  Clone ID: LIB3088-002-Q1-K1-A7
accaaccaaagtcctcacaactgattaactaagcttccttcaaactccaacgggggtataccaaaagagaccacaatcacaatcccaattgcaatagcaaataaacatataactac

SEQ ID NO: 79293 - DNA, 334 bp, Zea mays
  Clone ID: LIB3088-002-Q1-K1-A8
gctggcttgtcctccccctcttaccaaggcctcttcgggttaaggttacttagggggttgtggaagggcgatggcggcggctgatgtggagtaccgttgcttcgtcggcgggcttgcctgggccaccagcaacgagtcgctggagaatgccttcggcttctacggcgagatcctcgactccaaggtcatcaccgaccgggagacggggaggtctcgcggcttcagcttcgttaccttctcctccgagaactccatgctcgacgctatcgagaacatgaacggcaaggagctcgacggccgtaacattaccgttaaccaggcccagtcccgtggc

SEQ ID NO: 79294 - DNA, 294 bp, Zea mays
  Clone ID: LIB3088-002-Q1-K1-A9
cccacgcgtccgcccacgcgtccgaaaaaaaaaaaaaaaaaaaaaaaaaaaaaaagagagaaaaaaaaaaaaagaagaaaaaaagtacaaatgatatatagtgattcagatttatttaaacgtacttgcatatgttataagcgattagggggtgccattttatgggttttaattttccttcggtttacttgggaggccttggtatttctttgggtattttaaattaatttgcttggccgtatttttacatttcgaaagttggaaaaattttgaattgtccgattttatttgctt

SEQ ID NO: 79295 - DNA, 319 bp, Zea mays
  Clone ID: LIB3088-002-Q1-K1-B1
gcacagcgccgaagtccgacgatgttaatctcaagctccttgtcaagctctaccgtttcttggccaggaggaccaagagcaacttcaatgctgtcattctcaaaaggctcttcatgaccaaaaccaatcgcccaccaatctccatgcgccgccttgtcaagttcatggaatgaaaggagaagaacattgctgtgattgttggcacagtcacagatgcccagaggatccaagaggttccagcaatgaaggttactgccctgaggttcaccgagacggcaagggccaggattgtcaatgctggtggggagtgcctcacatt

SEQ ID NO: 79296 - DNA, 425 bp, Zea mays
  unsure at all n locations
  Clone ID: LIB3088-002-Q1-K1-B10
cggacgcgtgggcggacgcgtgggcggacgcgtgggcggacgcgtgggtgctgcagcagtgacaggtatggccgaggtagtgtcgtcctctcggtaacacgcggtgatctaggtgcctgccgcctaggtgacctttaccgctacttggaggactcacaattttgcttttccgattgtcgtgatctgggttcttactgcttgggggcagcttggaggagaccactcgccattttgcgttttcgatcatcggttactactggatcatggttcgccatcgatgctatgcacaaggccacgctagagctctctgcttgttgacgtgaatatngctctctccctcatgtttaagcctaagcagttgctttgcttggccnagacttttgagcactagcacacanaccacgctacacgcgctttgtgacacg

SEQ ID NO: 79297 - DNA, 433 bp, Zea mays
  Clone ID: LIB3088-002-Q1-K1-B11
agcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaagcccaaggcggagaagcggctacctgcgggcaagtccgccggcaaggagggcggcgacaagaagggtaggaagaaggcgaagaagagcgtggagacctacaagatctacatcttcaaggtcctgaagcaggtgcaccccgacatcggcatctcctccaaggccatgtccatcatgaactccttcatcaacgacatcttcgagaagctcgccgcggaggccgtcaagctcgcccggtacaacatgaagcccaccatcaccttccgcgagatcc

SEQ ID NO: 79298 - DNA, 387 bp, Zea mays
  Clone ID: LIB3088-002-Q1-K1-B12
cccacgcgtccgcacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatc

SEQ ID NO: 79299 - DNA, 395 bp, Zea mays
  unsure at all n locations
  Clone ID: LIB3088-002-Q1-K1-B2
atcccacgttacagtaaccttttcatatggctaaccaatcataataattctgcattttgaatgcttaggactgcacttctggatattggtaagcactactagaaatattcagagacaacatgaatggcttccaaagggctgggtgatggaggtaagagctggtggggagaaggcggacaagatgtacaagttttatgtccactcaatcactggtctacgattgctatcaaagcaagatgtactactctatatcaatgaggcaaaggtctctgggtgcgacaccaatggacaatgggacacaacttctgaagataacatactttcanaagtggactttcggccaagtggattgcctgaagggttgggtgaaagaactagtgtacagaaaaaccaag

SEQ ID NO: 79300 - DNA, 347 bp, Zea mays
  unsure at all n locations
  Clone ID: LIB3088-002-Q1-K1-B3
ccaagattggactatggggtggaccgggagggtcggcacaggacatcacggcagagcggccaccgcagcgtcttcacagcgtcaccgttcgtgctggcgttgccgtcgactccatcgagttcacctatactgacagcgctgggcagaggcgcgccgctgggcgttggggtggacttggcggcaatgttcgaacgatcgaccttggcaacgccgaggatgtcagggaagtctcgggaacatacggcgcatttgaaggtgccactacgctgacctcgctcaggctcgtcaccagcagcagaacctggggcccctggggggtcgagaacgggacgcgtttctncgtcacg

SEQ ID NO: 79301 - DNA, 177 bp, Zea mays
  Clone ID: LIB3088-002-Q1-K1-B4
cccacgcgtccgaaagatgcggtggcagcatcatactctatgcaagctaagagtgacagctgtgtttcagtcacatatatgatctagtctgtgtgtcaatgtgtcgaaaaacatgtctgtgattttgttatatgaatgtaacgcgcaatgaaacatacaggactagctgcttgcttg

SEQ ID NO: 79302 - DNA, 390 bp, Zea mays
  Clone ID: LIB3088-002-Q1-K1-A1
agctgttgtagctattgtgttgttgcagctacagccgaagcagtagccagctgaacatgctgacatgttattgcgggtggtcaaggctcatgattcagagcagaagatgcacataaatactggtgaatgatgccatcgacgatgatgaattgatgaaacgatggatgatgtcatcgatgaaagatggaatggaactcaaattttggtggtcgcacaagtgtggagacataaatttatatatacttagttaggctcaatgttagcacaaacagttgatgagcaagtttaaatttagagtacacttatgtatgagttatttgacaatgcttatttatgagatattgaatgatatttatccatattatattaaaaaaaaaaaaaaaaggccgg

SEQ ID NO: 79303 - DNA, 375 bp, Zea mays
  Clone ID: LIB3088-002-Q1-K1-B5
cgaacattataatcacagcatcgtatcaggctactatccaagggtttgaatcaaagggcttttcaaaagaacaaagtgaaaacttgttaacaaagagtgttcagattgcactggaagcccgtgagatgttcttgaaggaacatttggagaaatccactcctatacagcatcctattctggttgcagcagctctagggagttatggggcttatcttgctgatggctctgagtacagtggggattatggtgaagctggtacgaaagagttcctgaaggactttcatcggcggaggcttcaggttcttgctgaagcaggcccggatttgattgcttttgaaacgatccccaacaaatcggaagctcaggcatatgttg

SEQ ID NO: 79304 - DNA, 370 bp, Zea mays
  Clone ID: LIB3088-001-Q1-K1-G12
ggaacgggaatatatgctcttctttactttatgtaaaatggctgactgtattcttgcttgaacagcttggctgccctctgctgctgctggctcctggacgcctgcttctgacggaaccatccgtgccgggtccaacacggctgcaagtgaagcaaccagcttacggaagagctggaactgggccgtgctattctagctttgtcctgcgttatcgccctcttttcttttttttctctctctctctctctctggtatgagactactggtactctgtcgatgtcgattggattagactagggctggtgtgtattctgtggatgctccgtgtttctggtgggattcaagttcaaccctgggaataatggatttc

SEQ ID NO: 79305 - DNA, 362 bp, Zea mays
  Clone ID: LIB3088-001-Q1-K1-G2
cagaaacgagagggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacgggcagaacaccggaaactttcttacggaccgttctttgac

SEQ ID NO: 79306 - DNA, 407 bp, Zea mays
  Clone ID: LIB3088-001-Q1-K1-G3
gcgagcggccgtactttttattggtgtgtttgtatataatcaaacttaagaatgcctcatacatatgctgtgaatgcataatacagtaacacggccacttttacaaagaaaaaacggacctatcgccaatcactggaaagtacgagttacaactgaatatatgattgatataccctatatctaggaagactgacatcacagatgggagacatactaacaaatcgaagggggcatttaactgataaggctgacgctgaatcaccaaaacttcgggcctttccaggggcagtaacaacacccggctagttcatcggtctttcctcctgcagcaaggcatttaaccagtaataataccggcaagcacatcgctcttccctctcgcaaaaatagtgtagacaaggcgtatg

SEQ ID NO: 79307 - DNA, 112 bp, Zea mays
  Clone ID: LIB3088-001-Q1-K1-G4
ggtgtgctgtgctgtgcgatgtgctgtagcgaaatttagttgctcatgtcttctctccacgtttggaatttgcgttttcaatccggtattgaaggtataataattaacaact

SEQ ID NO: 79308 - DNA, 436 bp, Zea mays
  Clone ID: LIB3088-001-Q1-K1-G5
accgcaggctcccaaggcatctcttcgcaggttccttgagaagagaaaggatcggtaggttactcttgctgctgttgggacgacaagactgttgttttaacgatacagctcttcgaggaggatctatctaatctgtaatattcattgtttcagccttactgcgaaagcaccgtacccgggttccccttcagatgttacacctgtgaagaaggagatgtcggatggtcagccatggcttgggctgggacctcagatcgccaatcctgatctgagcttgtccaaggaggcgagccagtgatcgatgatccagcatcaccatcttcaaaactgcgatactcaacagccatgtgtggaagtgttctgttttgggcccctatcattccgggttttttttcgcatggataaataggttgtacgaaagtaaagaacacagcta

SEQ ID NO: 79309 - DNA, 432 bp, Zea mays
  Clone ID: LIB3088-001-Q1-K1-G6
cccacgcgtccgcccacgcgtccgcccacgcgtccgcccacgcgtccgtgtcgacgccgcacctgagcggcatcgcggccatcatcaagagcctgcacccgagctggtcccccgcggcgatcaagtcggcgatcatgacgtcgtcgggcacggcggaccacgcgggcgtgccgatcaaggacgagcagtacaggcgggcgagcttctacagcatgggcgccgggtacgtgaacccgtcccgcgccgtcgacccggggctggtgtacgacctcggcgccggcgagtacatcgcctacctctgcgggctgggcatcggggacgacggcgtcaaggagataactgggcgccgcgtcgcctgcgccaagctgaaggccatcaccgaggcggagctcaactacccgtcgctggtggtgaagctgctgtcccatccga

SEQ ID NO: 79310 - DNA, 297 bp, Zea mays
  Clone ID: LIB3088-001-Q1-K1-G7
cccacgcgtccgcccacgcgtccgaaaaaaaaaaaaaaaaaaaaaaaaaaaaaaaaaaaaaaaaaaaaaaaaataaaaaaagacaataaaaaaaataaataaataaataataatgaaataagatcaaatacatagttgatactgtaataacaaatagaggaaaaaagcgtgcgagctgttcaacagtgttacaaactggtatatcattcgtgttcactatttgcagtggtttcgagaacctcttggattatgataattttggactcttgtataatcattaatgatgatggtatatat

SEQ ID NO: 79311 - DNA, 138 bp, Zea mays
  Clone ID: LIB3088-001-Q1-K1-G8
tcgtgcattgggtttatcaaactggagaaacctaacgcgcggctatgaactctgggaaatctttgtaaaagctacgtaatgagaacctggttaggcaccttggtaggggataaagggggaggctagaacccccggtag

SEQ ID NO: 79312 - DNA, 330 bp, Zea mays
  Clone ID: LIB3088-001-Q1-K1-G9
cgtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcaagtaccagaagagcacggagctgctcatccggaagttgcccttccagcgcctggtccgtgagatcgctcaggacttcaagacggatctgcggttccagagccacgcc

SEQ ID NO: 79313 - DNA, 171 bp, Zea mays
  Clone ID: LIB3088-001-Q1-K1-H1
cccacgcgtccgccgcagcctgtacaatgtacatgtttattaggatagtacacctcgctagatttgcagatgtaaaacattgttgtgtaagctctcatatatatatatacacacttttgccctgaggcaatgagctgtatgtcatgttttaagagtaaaatgtgatttttg

SEQ ID NO: 79314 - DNA, 363 bp, Zea mays
  Clone ID: LIB3088-001-Q1-K1-H10
cccatccatttctcaccagaagcgaaggcggaggcggaggagcggaggtaggagatctcgagcaagccggaggcagaggagatgaagacgttcgacccgtggccggtcttcttccgccgggagtggaagcgcaactggcccttcctcacgggtttcgccatcaccggattcatcatcacgaagatgacggccaacttcaccgaggaggatctcaagaactctaagttcgtccaggaacacaagaagaagcactgacgaaccaggtgaaggagttgtcagaaacgcatgtttggccagccagttctgttatgcttttgaatgaaaaatttagacccttctttctcgtttccttaatcgaaatgc

SEQ ID NO: 79315 - DNA, 286 bp, Zea mays
  Clone ID: LIB3088-001-Q1-K1-H11
gggcaacatccagcggcaggagcatttctggttcggttcgattcgggctcacgagcgcatcgtgctgattcgcagggtgcactcgagctcgagtgcggagttgttgttgtactgtaggttgaggtttcaaaacatccatccgtccatcggccccgcctatttgtggatggtgtttctcgtgccattttagttcagctgtattgatgcttcgtcatgtatgtgtattgtaccattcgttcttgttacctactggtaaggcaacatttaatccatgttcaacgcgagc

SEQ ID NO: 79316 - DNA, 356 bp, Zea mays
  Clone ID: LIB3088-001-Q1-K1-H12
cggacgcgtgggcggacgcgtgggcggacgcgtgggccccagtccccacccaccaccagtcttcctcgctctccaaatctcgcgacgagaaagcccatctaggaccacaggggcgcgccagccggcaggaacgacgggagaggagggcatggagccggctgagcggatcgagtcggccgggacggcgctggggaagcgtccgaggagcagggtgctgccgcgcacggccagcatggtgacggtgccgtcggcggcgaagcaggggcgccaggagcggggcgccggcgtgccgtcgtcctgctcactgccggctgcctgcgccgggatggtggccgtgccggggggttactactact

SEQ ID NO: 79317 - DNA, 246 bp, Zea mays
  Clone ID: LIB3088-001-Q1-K1-H2
aagagacgacggactataaaaaaacaaagaaaaagaaaaacaaaataaaacacaggcgcatacttaagcgatggtaggcataatacatgtacactggtctctatatctgtgaacaacgcgggcgcatcggcaagtcacgtggaagtacgagttacaagtgaatatacggtggatggaccctatatgtaggaagactggcttcacatacgcgagactttgttgcaaattcaaggggggatgcaactg

SEQ ID NO: 79318 - DNA, 426 bp, Zea mays
  Clone ID: LIB3088-001-Q1-K1-H4
cccacgcgtccgcccacgcgtccgtgaactgggatggtctgagaacaaaggagaaagaacgtgtattagtacttgctgcaactaacaggccatttgatcttgatgaggctgttattaggcggcttccaaggaggttgatggtgaatttgccagatgcatcaaataggagaaagattcttagtgtaatactagccaaggaagatttggcagacgatgttgatctagaagctatagctaacttgacagaagggtactcgggtagtgatctcaagaatctttgtgttactgctgctcatcgtcctattagggagattcttgaaaaggagaagaaggagagagcttcagcagaaacagaaaataggccattgcctctgtcgcacactagcaatgatgtccgtgcattaagaataaatgatttcatacatg

SEQ ID NO: 79319 - DNA, 256 bp, Zea mays
  Clone ID: LIB3088-001-Q1-K1-H5
cccacgcgtccgcggacgcgtgggccgccatcttccagggcggagagcacatcatcggatgtgtgcgcagggtgctcgcaatagacaatcgatgctactacgattaagcagttgtaagaggatttataatatggctgatagtcaatttgagagctgcagtggtatagctcaagattatcagtgtaatacttatatttgacctgtgaacagacaaacatactctcgacattattggttagttctgataactgtactg

SEQ ID NO: 79320 - DNA, 413 bp, Zea mays
  Clone ID: LIB3088-001-Q1-K1-H6
cccacgcgtccgaacgaatcgagagtgctggtggaataattatgtgggctggaacttggagggtaggtggtgtacttgcaatgtctcgggcatttggcaaccgtctcttaaaacaatttgttattgcagaccctgagattcaggaacaagaaataaatgatgagttggagtttctaattatagctagtgatgggctgtgggatgtggttccgaatgaggacgctgtttcacttgtgaagatggaggaggatcctgaggcagcagcccggaagctgacagagactgcgttctcccgtgggagcggcgataacatcacctgcatcgttgtgaagttcgagcatgacaagcctggcggcggcggctactcgccttcaggcgacaagagttgattccatttgctgttggttatacgc

SEQ ID NO: 79321 - DNA, 286 bp, Zea mays
  Clone ID: LIB3088-001-Q1-K1-H8
ggaggatcgaagaattaactataatggccacgttaaccttcaagctggtactaacaaaatcgcactactgagtgttgcttgcggatcgtcgaatgttggagtgcattatgagacgtggaacaccggcgtcggtggtcctgtcgtgctacatgggtcggatgaaggttcgcgagaccttacttggcatgacctggtcctatcatgttgggctgaaaggcgagcagatgaatctgaactccatagaaggctcaggctcacttgaatggatgcactggtcactgatagc

SEQ ID NO: 79322 - DNA, 385 bp, Zea mays
  Clone ID: LIB3088-001-Q1-K1-G11
cgcaggggccgctgcggacgtgctgcggcggcggcgggccgtacaacttcaacccgaaggcgagctgcggcgtgcgggggtccagcgtgtgcgcggacccgtcggcgtacgccaactgggacggcgtgcacctgacggaggccgcctaccacgccatcgccgacagcatcctcaacgggccctacaccagccccaggctcctctgatccgaacgccggcggtgatgctcgtcgtccgtccatcggcagccgcagctcatacaactgtagtggcgccaacaatgtggctggcctgtgagcttgctagctgtggtaattaaacgaatgctgtacgtagtactccctactactagtgtgagagtgtgaccgtgttgggactggaactg

SEQ ID NO: 79323 - DNA, 407 bp, Zea mays
  Clone ID: LIB3088-001-Q1-K1-E5
ccggcatccacgagaccacctacaactcgatcatgaaatgtgacgttgatatcaggaaggacctgtacgggaacatcgtcctcagtggagggacgaccatgttccctggcatcgctgacaggatgagcaaggagattactgccctcgcgccgagcagcatgaagatcaaggtcgtggcgcctcctgagagaaaatacagtgtttggattggtggctcgatccttgcgtcgctcagtacgttccagcagatgtggatatccaaggatgagtacgatgagtctggccctgctatcgtccaccgaaaatgcttctgagctagctatctgccgcgcctttcatagcgtgtcaaggctgtgagatctgcggtgttgagttgagtgtctctatggagtatcacatactttctg

SEQ ID NO: 79324 - DNA, 434 bp, Zea mays
  Clone ID: LIB3088-001-Q1-K1-E6
cccacgcgtccgcccacgcgtccgcggacgcgtgggtgcgcaggctccgttcaagaacctgatgatgatgggatttatgatgtggatggcagggagcactgtccacctgttcagcatcggaattaccttctctgctctgtggcaacccctcaacgctcttcgatctgttgggaaagtttttgaaccatttaaggacccaagggtggatactactgctcctaagttgctctttattgccctcaagttggctgccatggcattgggtatatggaagctcaatacattgggccttcttccaacaaatccatcagattgggtgtcttctctggctcctgctcggcaggtttgatatgccgggagagggctccacttaaattaaatgccatttccatttgaacttattctactagttggaatattaataccgagtgaca

SEQ ID NO: 79325 - DNA, 434 bp, Zea mays
  Clone ID: LIB3088-001-Q1-K1-E7
cggacgcgtgcgtgcaaagatcctatatggcataacttggggcgatattttgacaagtatgcctctgaaaagttagcgacagataatacacctcatgatcattcaaaggagagtatggaagctattgtccagcaattgattaatttggcacaaaacacttctgctgacgaagagcttctttctgatcttgggactgatgttaaagacgaatgcaccaagtttggtctcggggataatgtcaaggtacacaatgtttgctcacctcatcgactcgagccatgtgagggttcagcgtggaggttcgtcgaggactgctgctcgtagctcctgtcgctccactcaagatccagcaggagtggagcaactacgataagaacttacgcgacatcacgattccttgaagcaacaagctgcgcaacatgaatactatgcta

SEQ ID NO: 79326 - DNA, 428 bp, Zea mays
  Clone ID: LIB3088-001-Q1-K1-E8
aggcagcatgcttctaggccagaagcctcgcctttggactttgtcattcgtccacagtccaaaattgaccctgagcagatacgagctcgtgctaagcaggctgtccaagaccagcgtcggctgaagatgaacaagaaattgcagcagctgaaagcgcccaagaagaaaaaccttcaggcgtcaaagctcagcgtggaaggccgtggcatgatcaagtacctgtagatcacccactgtggcatccgcagtcagcagtgtcctgcacatgatacagcgcctgcagggattgctgaattggtatgaagcatcctaccaccattccatggcaaacagctcggcatcagtaattgcttggatcttttatccaagtatttttcttgcctgcaacatccgtgcttcagaaaccagttgagttggctacactatca

SEQ ID NO: 79327 - DNA, 426 bp, Zea mays
  Clone ID: LIB3088-001-Q1-K1-F1
cggacgcgtgggcggacgcgtggggctgcggcggcatgctgcgcctagacatgggcaccgaggagcgcgccaaccgcctcatgcaccacgtccagaacaccacccagctcggactcatggccgtcagcctaggctactacgagacgctcatgtcctgctcctgcagcagcaccagcagcgagatgccgaccgaggaccgcgcgcgcgcgggcatctgcccgggcctcgtccgcatgtccgtcggctacaacggcacgctggagcagcgctgggcgcagttcgagcgcgcgctcgcgctcatgcagacgccagcgcccacgcaccatcttaaggccgacggcgacgaccgtgacggtcccgaagccggcgacaaccagcaccgtaagcactgacgcgcttgcgctttcgagcgtgcatggcctgtgt

SEQ ID NO: 79328 - DNA, 80 bp, Zea mays
  Clone ID: LIB3088-001-Q1-K1-F11
agcacggaagattgttgtcgctgagggcctgcacaagatggttgaccttctacgcggtggcgacactaggatttcggagg

SEQ ID NO: 79329 - DNA, 318 bp, Zea mays
  Clone ID: LIB3088-001-Q1-K1-F12
aaaaaaaaaataaataaaaaaaaaaaaaaaaaaaaaaaaaaaaaaaaaaaaaaaaaaggggggaaaaaaaaaaataaaggataataaataaaaaaaaaaaaacaaaaaaaaaaaataaaaaaatataaaaagacaacaaaaataaggggggggcgtttttggggttcctttttttggattctggggctcgcgagggtttttactcctttttggggcccctcctcttgatattttggggcgcttgttttaatcgttctttggggtttacccctgggggttccccatttttgggcttttgtgaaacaccctggttttccg

SEQ ID NO: 79330 - DNA, 320 bp, Zea mays
  Clone ID: LIB3088-001-Q1-K1-F2
cccacgcgtccgcggacgcgtgggggcttgaaaggtttggactttcagagcctgtaccattttacagtgggcgctcctgtgcttgacaagaggataatgagtctcccagcttaccctggtcccggaattgacgcatgatatcttgcctcgggggaattttttgtcgacagatcaacaaagaaccgtggagcctgactgttttggtttatgtgtagtggcatgcctgaaatctatgcattgcatgccccggtactacccactcactcgtattttatctagttgttagccacgacgatcctatgttgcaccagcgtacaagt

SEQ ID NO: 79331 - DNA, 403 bp, Zea mays
  unsure at all n locations
  Clone ID: LIB3088-001-Q1-K1-F4
cttacattttgcatgtgggtacggtgagttgaagtgtgcccagatccttcttgaagctggtgctgcagtggacgctcttgacaagaacaagaacaccccgttgcattacgctgctggctacggccgcaaggagtgtgtggatcttcttttgaagcacggtgctgctgtaactctccaaaacctggacgggaagacacctatcgatgtcgccaagctgaataaccaggacgaggttctgaagttgctcgagaaggacgccttcctttgaataccatgcctttcgtatacacttggactcttggtgtcatgtttttttttcataccggttgtttttgtctggatagccacatgtcatgggccttaaatctgntatgcctaaatgctattagcatgtgggtgttcg

SEQ ID NO: 79332 - DNA, 294 bp, Zea mays
  Clone ID: LIB3088-001-Q1-K1-F5
cccacgcgtccgaaaaaaaaaaaaaaaaaaaaaaaaaaaaaaaaaaaaaaaaaggaggaaaaaataaaaaagggaggtaagaatataaaaaatgcatgcatcattatagcatgtttgatagggtttcgttattttattttgttgccttaattttttcaactggccgactgtttaaaccttggtgtttgcgaactcagtggcgtttcccaactttttcgttttgcctgatgtcgtctttttgctggggctcgtatttatggttattcctgttattttcgcattttgaatgggttt

SEQ ID NO: 79333 - DNA, 297 bp, Zea mays
  Clone ID: LIB3088-001-Q1-K1-F6
gtcagccacctccaggagacgggcgtcctggagaacgccttcggtggcgacaagacctccgcctgagattccaacattcatcacgcgccgagagctctcggcaattatcacgcgccgagtgagcgctcgtttcggccgtctttttttccactgtaccaatcatcctgttgctaccagtagtggtctagcggagaatgatgcacacttccccccgctgggaacgcggcgatttttgctggaacagttgaaggccgagccggggcgaatccttttggcctggccgtgcactgcttgctg

SEQ ID NO: 79334 - DNA, 436 bp, Zea mays
  unsure at all n locations
  Clone ID: LIB3088-001-Q1-K1-F7
gtttcagcaattcagctccctcgcctccgccgcggcaccggcactacgagtgcttcgctaccagccagccagcacactctacgagtcgccatcttccactccaccgaggcagctccaagccatggccatggagaaggccgcctccttcctctcctccctcttaggcggcggcggcggggagccggcggcgactgtgaaatctatcttcatataccctatcaagtcctgcaggggtcttgccgtgtcacaggcgcccatcacctccactgggttccggtgggatcggcagtgggtggtggtgaacgccaaagggcgagcatacacccagagggtggagcccaagcttgctctggtccangtggagttgcccgccgaggccttcgctgagaactggcagcccacgcccgacgaccacctggttatcagagcacccgga

SEQ ID NO: 79335 - DNA, 431 bp, Zea mays
  Clone ID: LIB3088-001-Q1-K1-F8
aattcattcatcttccatggaggccatgcccaggccaagtgtagctccctcgttgcagttgcagctccgcccgtgcccgaggtggccgagccggaagcactgcccaccgtcctccgtgccaagccggagggttgcttgctcgtcctcggcggccgacgccgacgtggtcgacctcttcgacgccgctaagctcactgtggacaagttcgtgacgagcggcatggtggtggggctcggctccggccctgcgtccgccctggccatccagtacctcggcacgcgccttcgccggggctctctcacgggcatcaccgcagtgacctcgtccgtgctcagtgcgagcgaggcagacaaggcaaggatacgggctaacagctaccaggaaggcacccagattgattttgctttcactgatgctgaagcgatcgaag

SEQ ID NO: 79336 - DNA, 425 bp, Zea mays
  Clone ID: LIB3088-001-Q1-K1-F9
agaaaaacaagcagaagctgcttggaaagaaagtgagtatcgcgcgatcagatgcgagcaagggtaagaagagccgtgaagcaggtcaaacaagccaggataatttacctccgagtggtggtgatgatgcaaaagcaacaggatccagtggaccagacaatgaagtacccaagggtgatgcaaaaaccatagggaagaataccctttttgcaccacgagctctggttaaacctcttggatggacaaacaagggtgagaagaaaccagatgttgcacgggagttgaaatcaaatgaggagttccgaaatctgttactaaagaagtgatatcagttggcaggtgtggatcttcatgccccaatccagagccaagatttgtggtgccttcatctctatgttagaatgatggacctgtaattgcagctt

SEQ ID NO: 79337 - DNA, 435 bp, Zea mays
  Clone ID: LIB3088-001-Q1-K1-G1
gtcagttttcttgggccaatggaccccagagagcgtgggcgattatgcgagcgggacgaaccatgtccttccgacctatggttacgcaaggatgtacagcggtgtatcgctgaactctttcctcaaatacatcactgtccaatccctaacagaggaagggctgagaaagctggggccgtacgtcgcgaagatggccgaagtggaggggctagaggcgcacaagagagccgttacccttaggctgcaagaggttgaggccaacataactgtctagctgctgtccatggtctattgcaaatttgcaatgttcagactcgatgtgggatgctggagttcttccctaggaaccttggggaactggactattgatgtcttccaaacatgctctggaatgttagaaagaggcgtttcaactggtgcagctaataatgctca

SEQ ID NO: 79338 - DNA, 393 bp, Zea mays
  Clone ID: LIB3088-001-Q1-K1-G10
cttcgttgcgcttcttggcttttcagtatatggtggaaggttatttgtcttgctgagacgtttccctattgaatctaaggggcggcaaaagaagctttatgaggttgggactgtgacagcaatttgtgttacctgcttcctgataagatgtgttgtggttgcattatctgcgtttgatgccgatgtatctctcgaggttttggaccatccagtcctagatttcttctattatatgcttgcggagatactgccttctgcgctagttctcttcgtccttcggaagcttcctcccaagcgggtttcggcacaataccaccctattaactagagagttttttttaatgatgttacatgctaagaactccggataatctgaaactactggaaacctac

SEQ ID NO: 79339 - DNA, 301 bp, Zea mays
  Clone ID: LIB3088-001-Q1-K1-E4
cccacgcgtccgcttccagcaagaaggacaaaggaattaagagctttgattggatggaggtattacttcagcttattcttagagttgtcagatattgccatgcccttcataagggttgctatcagcaaagtgagctctgcggtgtcctacttctgggtgtcaatgattggaaggtctcttgggctgattttctcagggattagacaatcactaggctggaaataagcttatacggtcatacctgttgagttttgagtctgacttctgcgactgaatgaatgtctgttaggttatgcattgt

SEQ ID NO: 79340 - DNA, 412 bp, Zea mays
  Clone ID: LIB3088-008-Q1-K1-E12
cccacgcgtccggaattacttcgcgtcctttacccagtttttatccattgcttgatggaggtagtggcagagggacatatgcacaatgctcggtcatttttccatacatttcgggaagctcataaggtgatgcattcaagggatcttcagaagctggaaggcatcctctctccttcacacttggaggttatttagctctgcactacattgtgccattatgttgtgaatggacccatgtattggaatgtgaattgtgaacccataaccctaaacagggttgggtgtggtattaatagacttgagtaattgggtctggcccattacaacgagggtgagacggtaattacatggggaaggccccaaaccctagacgggtagtctaccccctcgcagtcacaactctatcctgtac

SEQ ID NO: 79341 - DNA, 459 bp, Zea mays
  unsure at all n locations
  Clone ID: LIB3088-008-Q1-K1-E3
atcgcgagcgccgccctttttttttttttttatacaatgtgttccattcgtatgatgttggtagttgctacatacaaatacagcaaactagtagaatcgaggacataaatagtcacaatccgaatatcattgtcctatagcgcccaaaatcttgggtgccaattctcataatctgagtcatctgtgtcatcactttcagatgatgaagctgctagatcttcaacgcgcaatatgtatttagcaacctgatccaggatgtatcaggtaacagaggtcgtagttttacttcatggtgtctattcttagggcaatggtgtggagaagcacatgtgaagttgctcagccaaataactgatctgcaatgcgcacatagtgctctatttgatacaaatttccatgacgcgcattcttcatacttagtgtggaaggactccttncagctaaagcttggataatttg

SEQ ID NO: 79342 - DNA, 448 bp, Zea mays
  unsure at all n locations
  Clone ID: LIB3088-008-Q1-K1-E5
cccacgcgtccgggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcatcgacgatgcggaggctcagtacaggaacttccagcaccccgatccctacattgttccatgggcaccaggcggcactaaattcacaagaaaccccgctacacctcaagggatcgagatcatctacaattatggcaaggaggaccagtaaacaagagtcctgcaagcggagggcagaacttncacagttccaaatcacttcctggttaatcgaagttgtgtacgagaaataagaatgaaatta

SEQ ID NO: 79343 - DNA, 434 bp, Zea mays
  unsure at all n locations
  Clone ID: LIB3088-008-Q1-K1-E6
cgtggtctgaattaatccagttgaatttcttaaaacggttcctggggaaaggctttctgaagcatgtgcaggagaatggacttcttcaggatatctttgacattaaggttgacaaaactgaaaccttgtcgtccactgataagaaaatttttaggtctgaagaggaaaaagaaagagctctgagattaaacaaggaacgtcgtctagcccaagtaaggaagaatgccgtcatgttggatgagtaacaaggtcaagaagagaaggggaaacaacatcgatttctgtatctcatttcatccgggcctttgtctgtttgcacattcattggaagatgtgccttcatgatagtgtactttaaagatactggagttttatagtgcatttaaccgatatgctntgtgtcgtgcattttgaacgtcagcataatttgtggg

SEQ ID NO: 79344 - DNA, 313 bp, Zea mays
  Clone ID: LIB3088-008-Q1-K1-E8
tccacgcgtccggatttgcagtctacttttgttttatcgtgcaatacctcaggaaaccgtgcctacatgatgcgatcgaaaccggagacgttcctgggtcaagcttcgttccgtaaaataaataaatccgaagcacttcaaagctctacatactcgcccttgcttgtttgagacaagggcttgcgttcttgctgcatctcatccgagatgattgtaatccgaacaatgtgtagttaataaaaatgtcgctttgccctgaaaaaaaaaaaaaaaaaaaaaaaaaaaaaaaaaattaaaagatataaaataaaaa

SEQ ID NO: 79345 - DNA, 437 bp, Zea mays
  Clone ID: LIB3088-008-Q1-K1-E9
cccacgcgtccggtcgtgggatcccagccaccgccgctagaagaagagctcggcgattccgaggtcccgcgagaagatgccgaagcagatccatgagattaaggacttcctcctcaccgcgaggaggaaggatgcccgctcagtgaagatcaagaggagcaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgtcgggttgaactaccaaagcttctttatcagtagcagagtatgctactctatgtacttttggaacctaagctattagacctgtcagtgttggatgtgtggatcttgcatttttggagaaataccaatttacctc

SEQ ID NO: 79346 - DNA, 360 bp, Zea mays
  Clone ID: LIB3088-008-Q1-K1-F1
gccactcgttcggttgaatctgacaggaaaatcttatcacagactggtaatgcactcactgagcctggggatatatatagtgaatggattgatgagtgtgagcgtgtcaacactgttgaaggcgactacgatgcatgagcttgacccatgcgatgaaactgttacctacaatcgtaatgtaatgagctgacattctcgaatgccatagcccatagtcagccatggcttgtaataacgtgatggctgaccgatatgccagtaggcaccttatctagtacttacagaactacaaaacgttcgtactatacatatatgggcaaccttataagtggctatttgagtacctatcctaacgcttat

SEQ ID NO: 79347 - DNA, 357 bp, Zea mays
  Clone ID: LIB3088-008-Q1-K1-F10
ggtaaatgtatattatgtaacaaccatcaactcgtggatcctggacctgaacaggagaatgtgtttgcttgctatatgtgaaaattaggtgggtatgttgaagttgaccctgagttcgcaagtttagctttcaactttgagactatctcgctgaaccaaatatgtataccagctggagagttgagccagaggacacgtgctagttagctgttcttctcgtgtctgtatttctcagtctgctctcaaagtatatttaatgtatgacgattcaggttagcttaaaaagttgtgttatctgagaactcaaaaaaaaaaaaaaaaaaaaaaaaaaaataaaaaaaaaaataaaaaaaataa

SEQ ID NO: 79348 - DNA, 430 bp, Zea mays
  Clone ID: LIB3088-008-Q1-K1-F11
ctgggactccatcaggcagtgggcgtccgagtacgtcaacgtctactacaagtgcgacgaggccgtggccgtcgaccccgagctgagggcgttctgggacgaggtgcgcaacgtggggcacggcgacaagaaggacgagccgtggtggcccgtgctggacacccgcgacagcctggtggagacgctgaccaccatcatgtgggtcacctccggccaccactcggccgtcaacttcgggcagtaccacttcgccggctacttccccaaccggccgaccaccatccggaagaacatgccggtggaggagggcgggccgggcgaggagatggagaagttcctcaagcagccggagacgacgctgctggacatgctgcccacgcagatgcaggccatcaaggtcatgacgacgctggacatcctctcgtcgcac

SEQ ID NO: 79349 - DNA, 232 bp, Zea mays
  Clone ID: LIB3088-008-Q1-K1-F12
ctgacacttggtcaggctctgggcctccatctgcctcaatgtctactacaagtgcgacggggccgttgtcgaacgtgcctaagctgatgtcattctgggacgatgaactcatcatgtgtcacagctacaagatagacgagccgtggatatccgtgctgaacacacaatacagcctgtggaacaacgctaaccaccatcatcgtgctaacctccgtacatcactagcgcgcga

SEQ ID NO: 79350 - DNA, 190 bp, Zea mays
  Clone ID: LIB3088-008-Q1-K1-F2
tcttctcaagcttcttccgtaaaacaaatataatcgcacacttctaatcttacatactcatccttgcttgttacatacaattgctaacgttcttgctgcatctaattctctatgattgtaatccgaacaatgtgcatttaactaaaatgtcgcttttacctgaaaaaaaataccattgtaatgacatatt

SEQ ID NO: 79351 - DNA, 410 bp, Zea mays
  Clone ID: LIB3088-008-Q1-K1-F3
cctcgatccagacagcaggcagcagccatgtccaaggtcttcaccctcgacgcggtcgcgaagcacaactccaaggaggattgctggctcatcatcggcggcaaggtgtatgatgtgacgaagtttttggtagaccacccaggaggtgatgatgttctgttgtcctcaactggcaaggatgcgactgatgatttcgaggatgtcggtcacagcaacactgcccgcgcaatgatggatgagtacttggtgggtgaaatcgacgcgtcgacgatcccttccaggacgaagtatgtccccccgaaacaacctcactacaaccaggacaagactcccgagtttgtcatcaagatcctccagtttttggttcccctggcaatcctgggcttggctgttgccgttaggatgtacac

SEQ ID NO: 79352 - DNA, 446 bp, Zea mays
  Clone ID: LIB3088-008-Q1-K1-F4
aatatttcataggagttaaagtgcacatacctaatcaagtctgtgggtctccaattctgagatagaaagataatttatgttctcatctttctgaaatgaacaagatgactggcttatgggttaaggtttttttatagagcaccatgacttatcagttttgtgaacaaccctaacttatgtggtcctggcaccacaaaaccttgtcctgatgctcctcccttttctccaccttctccatacaaccctacaaccccgatgcaatcaccaggaagtagctcttccactactggagcaattgttggtggagtggctgctggcgcatccttgctatttgctgttcctgctatcagttttgcctattggcggcacaggaaaccacaagagcaagcatttttttcaatgtatctggcttcaaagttagtctttgattattatctttctcgcaa

SEQ ID NO: 79353 - DNA, 329 bp, Zea mays
  Clone ID: LIB3088-008-Q1-K1-F5
gttcccacaaatcaaagctcacccatggcacacggtattcaacacaaggatgccgcctggagctgttgatctggtctctcggctactccagtactccccaaatctgagatgcactgctgtggaggcgcttgtccacccattctttgacgagcttcgagatcctaatactcgtcttccaaatggccgcttactgccaccccttttcaacttcaagcctgacgaattgaacggagtcccagcagacattgttgcgaaattggttccagaacatgcgaagaagcaatgctcttatgttggatcgtgagatgaccgtgccttgggactggaac

SEQ ID NO: 79354 - DNA, 445 bp, Zea mays
  Clone ID: LIB3088-008-Q1-K1-F6
cggacgcgtgggcggacgcgtgggcacaggacttcaaaactgatttgcgtttgcagagcgatgcggtgcttgccctccaggaggctgctgaggcataccttgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttatggctagggtcgaatacttaagttaactatgcgctgacagtctggactagcagtgttatgtgcgctgctggaccttgcgcgcaatgctgtg

SEQ ID NO: 79355 - DNA, 405 bp, Zea mays
  Clone ID: LIB3088-008-Q1-K1-F8
cggacgcgtgggcggacgcgtgggttgttgatgtggcccacactaccatccggaatgagccaaggatcaactggctatgcaatcctgtgcacaagcaccgggagctccgtggtctcacctccgcaggcaagaagttccgtggcctgcgtggcaagggccacactcaccacaagaataggccgtcgaggagggccacctggaagcgcaaccagaccctttccctccgccgctaccgttgagcacatacaatttgatgttctgctactgtggaacctacctcatgcatgctctgatagtatttggtatttttgttgcatcgttaaattttgctacccatgttacaagctccttgaactctgttatcagtgtaccatggagaaattgaagcgaactatgtttgtggtt

SEQ ID NO: 79356 - DNA, 413 bp, Zea mays
  unsure at all n locations
  Clone ID: LIB3088-008-Q1-K1-E11
agctggactgccgcaacatcaccttcaactaggcccagtcccgcggaggtcgtggaagcgtgtgcagcggcagatgctgtggtggccgtggatgcagaggatacagcggtggctgacgccgtgatggcggatgcggctacagcggtggccgcggctactgtggttgctgcggcggctacggtggtggtggcggcggatacgtgcatggtaaccgtggcggatgctacggcaactccgacggtaactggatgaactgagcagtggtgcccgcgcggccaagttatcctgttcgctaccgtgttgtttaccctagtacaaagtgtttatcttagttcgactcgtgtttgatgntacccatctgtgttactgattgaaggtcactctgagtcagttgatagtgctatgttcaatat

SEQ ID NO: 79357 - DNA, 427 bp, Zea mays
  Clone ID: LIB3088-008-Q1-K1-C3
cccacgcgtccgtgaaattcgtggccagtcagtttaggaggctgcacagcaggcaagtgcagcacacattccgattctattcccagcagtggaggacctgggcagcctgcttcatccaagcagcatggcgccgctactacaagaggaagatggcggagcagcggcgcaaagaagaagaggcggcaagccggccaagtagtagccaccctagccttggggcgactatctatgcatctcgtttcgctgccaacgccatgcgaggggttcacaggctaagaagcaaggctgtccctaccattgtcaggctaccgaaacccccagaaccagattttggtgtcgatgatgctgactaacgagacaatcacactgtactcgcttgtaattgtactttacctcatctgtagattctgtacaagaatcaacgaca

SEQ ID NO: 79358 - DNA, 134 bp, Zea mays
  Clone ID: LIB3088-008-Q1-K1-C4
aaaaaaaactatactcgaaaaaaaacacgtttctaaattataaaaaaaacaaaataaactaagggatcaagtaacaagctcaacagtactaaacaaacacaaatgaaatataaaatacaaaataaaactacaaa

SEQ ID NO: 79359 - DNA, 305 bp, Zea mays
  Clone ID: LIB3088-008-Q1-K1-C5
cccacgcgtccggaatgaggttgcagaaatggacaagaagggtatcatagagctgcacagttacctcactagcgtttacgaggaacgcgacgcacggacaactctgctgtccatggtccaggctctgaaccacgccaagcacggggtcgatatcgtatcggggaccagggtgaggactcatttcgccagacccaactggaaggaaagtttcaccaggatcgcctgcaaggatacgaattcaacagttggtgcgttctactggggcgcaacgaaccttggcaaagagctgaagggtctggcgcacg

SEQ ID NO: 79360 - DNA, 368 bp, Zea mays
  Clone ID: LIB3088-008-Q1-K1-C6
cccacgcgtccgcggacgcgtgggtttctgttcggggtctcttatcccagccggcccaggaactgaactgaacgggactcgccgcagacggtggagatgaaggtgcgcatcgactgcgaagggtgcgagcgcaaggtgaagaaggcggtggagggcatgaagggcgtgagctccgtggaggtggcggccaagcagaacaaggtgacggtcacgggctacgtggacgccaccaaggtcatgcgccgcgtcgcctacaagacaggcaagcgggtggagccctggccctacgtgccctacgagatggtgcagcacccctacgcgccgggcgcctacgacaagaaggcccccgtcggctacgtccgcaacgt

SEQ ID NO: 79361 - DNA, 460 bp, Zea mays
  Clone ID: LIB3088-008-Q1-K1-C7
cccactcgtccgcccactcgtccgtgtaattccagtggacaagacacataactgtgatggtatgtatggctttctgaagaaaaattgggagattgcaagatgggttgctcttggcgttgttgtttttgaggcagtgctctttctattagctctggttgtcagggcaatgaacaaacctgcggagtatgacagtgatgatgaaattattgcaattggccgaagccctaccatgcggcagccattgatccatgcccaaaatgtgccggccaccggtgttcctgtcccaacactcgatcagcgtgcaagtagaaatgatgcctggagccaaaggatgcgagagaagtatggtctggacacgagccagttcacctacaacccctcagacccaagcaggtaccagcagaatggcgcgccacaggctgaagaaaggagtcgatgcactataatgtgaagaattctt

SEQ ID NO: 79362 - DNA, 362 bp, Zea mays
  Clone ID: LIB3088-008-Q1-K1-C8
cccactcgtccggactggcaagaccatcttcttggaggtggagagctctgacgccattgacaatgtgaaggccaagatccaggacaaggagggcattcccccagaccagcagcgtctgatctttgctggcaagcagctggaggatggtcgcaccctcgcggactacaacatccagaaggagagtacccttcaccttgttctccgcctcatgggtggtatgcagatctttgtgaagaccctgactggaaaaaccataaccctggaggttgagagctcggacaccatcgacaatgtgaaggcgaagatccaggacatggaaggcatgctgccggaccagcagcgtctgatcttcgacggcaaac

SEQ ID NO: 79363 - DNA, 463 bp, Zea mays
  Clone ID: LIB3088-008-Q1-K1-D1
tcagccgacgcgtgggcggacgcgtgctcggactcgtgtgtcagacgcgtgggtatcttattatgggtatgggtttgccttgcacagtgttagttggccatttttttgtgaggtacctttgtgcaagtgaatactgaattggaggagaatcttatgtagggaatatagataacaggcgctccatatataaacttcgttattaggtgctgtatggactatggttcacatatttgtaacgtgaacggtaaccgataatgttaaaacatgtttgtttaatttcaaccgtaatcagataccacactagaaactgatatcatcctaaatcattattcttgcaatttaagttagtggagaatctttagcgggcaaggctagcaactcacaatgtgaagagtgggcgtagccgaacaccttaagactgatttcatggctgtattacatgccaagtgctttttcgacgcat

SEQ ID NO: 79364 - DNA, 438 bp, Zea mays
  Clone ID: LIB3088-008-Q1-K1-D10
ggaccgtcactgggcttgagttgctagtaacaagtgggcagccaccgaatgcagctgctggtactccattggagaatctcttgctgactaagcgtgcagaaatgaccgctcctgagttgtttattgctgaggagatcaatgcagaattcaaggagtctattcttgtgcgtgttggattgaagggtacaatcttcctgcggaccttgccactgaataaggcagcgggtaaggagacagagttctcatttcgtcttgagggcacatcaggaatgaagagggctgcattgcagagtaatgtcttgagtaacctacagaatggactgttccatgtcaggaccgtgtcgaaagaagaacccattcccctcatgaagtacagcttcctgccgaagcactcacctctccctttgaggatgcgcctagtgaagcgtcatagtggaa

SEQ ID NO: 79365 - DNA, 438 bp, Zea mays
  Clone ID: LIB3088-008-Q1-K1-D11
gtgtggtttaaaattggcaagtatgccagggcttctaagagatatgaaaaggctttgagctttgtcgagtacgatagctccttcactgaagaagagaagcagctatcgaaaccacttcagataagctgcaagctcaacaatgccgcatgtaaactaagacttaatgattacaaggaagcaaaggaactgtgtaccgaggtcctggaatctgacaacacaaacgtgaaggccttgtacagaagggcacaggcacacatgcatcttgttgatcttgatttggcagaggcagatatcaagaaagctctagaaatagatcctgacaacagggatgtgaagatggggtacaagaggctaaaggagaaggtcaaggagtacaaaagaagggatgccaaattatatggcaacatgatttccaagttgagcaagcttgaagacacg

SEQ ID NO: 79366 - DNA, 370 bp, Zea mays
  Clone ID: LIB3088-008-Q1-K1-D12
gccacgcgtacgatcgcgcggtctgccacgcgttcgactggatacgctctggttgaggactgtctgtgcgccgagcgatcttacgcggacgaacagagctgcgtcttggatgcatttaacatgatctacgcgcgactcactgtcagatgttaacttggagtgcttgatatcgtggaagctgatgaactgagtaccgatagtcctggcatatgtctacacatagctgagaggcctcgagcgatatggcacagagtctcatgcgttccgatgatattgatatgtcccaggcccatatcaagaaagctctagttatagacactgacaacagggatgatatgatggggtacaagaggctggacgagaaggtcta

SEQ ID NO: 79367 - DNA, 297 bp, Zea mays
  Clone ID: LIB3088-008-Q1-K1-D2
acggacggacccactcatgctatgactcaaaaactgctacgggcctgcgatattagatgacagagctactgcagagacgggggcacgcccacccatctctgaggtgcacatctacactgccgctggctacgcaactgcatgccgtggagggagcaaacatctcaggtactgttgacacgcattgaaatgtgcatcttactaacacaactcacgattgaccgccggtatgtatcccacgattatgaacaacacctggcgaccgctgtcatgcaactactacacatttcaagccacaag

SEQ ID NO: 79368 - DNA, 277 bp, Zea mays
  Clone ID: LIB3088-008-Q1-K1-D3
gcactcatccgcccacgcgtgcgtccacacgtactaaaaggtcaagctcttgcttatgagtactgaatcagggtatgtgaaaccattgcacagacttacctgaacatttatcaggtaggtacctccatgcaacttaacactgaatagaaggttaatcttacttattgaatatccataaccagcgctccatatattaactagccaaacaagtgctgcatggactatggttcacatatatctgacttcaacggttaccaatcatgttcacacatgtcat

SEQ ID NO: 79369 - DNA, 222 bp, Zea mays
  Clone ID: LIB3088-008-Q1-K1-D4
tcgcccacgcgttcgcgacgtgtacagcttcggcgtggtgctgctggagatcctgatctgccggaggtgcgtggaggcggagtacgtctaggggagcaacatcgtggactgtacgaggcgtaatgtcgccggcggcaacttcatggacgctgcgtactgtgcataccagctgacctgtgaggcggtccagcactagacggtgttgtcgctcggcatggatcc

SEQ ID NO: 79370 - DNA, 449 bp, Zea mays
  unsure at all n locations
  Clone ID: LIB3088-008-Q1-K1-D5
ctggatatcaatgtacttcaagattcttttagtggttgcaagagctgataatgagtatctgtttgccttgcacaatgttagttggccatttttctgtgaggtacctctgtgcaagtgaatactgaattggaggagaatcttaggtagggaatatagataacaggcgctccatatataaacttcgttattaggtgctgtatggactatggttcacatatttgtaacgtgaacggtaaccgataatgttaaaacatgtttgtttaagtccaaccgtaatcagataccacactagaaactgatatcatcctaaatcattattcttgcaatttaagttagtggagaatctttagcgggcagggctagcaactcacaatgtgaagagtgggcgtagccgaacacctcaagactganttcatggctgtattacatgccaagtgcttttccgaccc

SEQ ID NO: 79371 - DNA, 427 bp, Zea mays
  Clone ID: LIB3088-008-Q1-K1-D6
cggacgcgtgggcggcaacggcggcggcgggttaggtgctggtgctggtggtggcacgggcggcctggggcccacctctcagctgcacatggacagtgccgctgcctacgcgactgctgccggtggagggagcaaagatctcaggtactctgcatacggggtgaaatctctgtcggacgagcacagcacgctcttgtcgggcggcatggatccgtcgatgatggacaactcgtggcgcctgctgccatcccaaaccaacacattccaagccacaagctaccctgtgttcggcacgctgagtgggctagacgagagcaccatcgcgtcgctgccgaagacccagagggagcccctctctttcttcgggagcgacttcgtgaccgccgtcaagcaggagaaccagacgctgcgccctttcttcgacgag

SEQ ID NO: 79372 - DNA, 216 bp, Zea mays
  Clone ID: LIB3088-008-Q1-K1-D9
cacacgcgtgcgcacggtttggcaatggcgcactacagattgcactatacaagaggctatgtccatggcgtgaagagaacaggaatattgaaacagtatcaaaaatgggagtgacgagtgttttagtagagaacggggtgaaccttgacatgtttaagctgggtctcagtaactttgcaactaactaggctgccttcagcataaaagatgattaat

SEQ ID NO: 79373 - DNA, 100 bp, Zea mays
  Clone ID: LIB3088-008-Q1-K1-E1
aaaaaaaaaaaaaaaaaaaaaaaaaaaaaataaaaaaaaaaaaaaaaaaaaaaaaaaaaaagaaaaaggaaaactactaaaataaaaaaaaaaggcctaa

SEQ ID NO: 79374 - DNA, 443 bp, Zea mays
  Clone ID: LIB3088-008-Q1-K1-E10
ttgagctgtcaggtcggagctcctctgtgtaacgcttgcctggaactgcttcagtgatttggatggttattgagatgagtgcgagcagataactgcaagggtgcacacctggatgctcattaagaggtgtgactaacaatcaaagaagatcaagaggagcaaggatgttaaaaagatcaaagtgcactagatacaagtactagtacacactgggcgtctgctatactggaacaagcctaccagacgcatcaatctattgccataggtttgatcttctatgacctaatagatagtatacatgccagcgtttaacaaaactacgactgctaaaacattagtagcacacaattctactgtatgtaattacataacctaatctattacacctgtaatatcaaaaatggccggacctagcatccttccaaaaattccagcatacctaa

SEQ ID NO: 79375 - DNA, 387 bp, Zea mays
  Clone ID: LIB3088-008-Q1-K1-C2
tcggtagcatggagcctgtatttaaaaggggtgatatcctgtttttgcatatgagcaaagatcctattcgcacaggagaaatagttgttttcaatgtcgatggtcgtgagattccaattgttcaccgagtgattaaggtccatgaacgtcaggacactgcagaagtggacattctcaccaaaggtgacaataattttggggatgaccgactattatatgcacatggccagctttggcttcagcaacaccacattattggacgtgcggtgggctacctttcatatgttggctgggttacaattatcatgactgagaaaccatttattaagtacctgctgattggcgcactgggtttgctggtcataacgtcgaaagattagtgatgtc

SEQ ID NO: 79376 - DNA, 379 bp, Zea mays
  Clone ID: LIB3088-008-Q1-K1-A5
tcgaccacgctccgaaagaagatattctgtgctatgaaatggcggttacatagacgctaagggtgcagcttcaagtacataatggtcaactggtggtatatgcatatgactagaactgaatcttgtggtgaattttcaagttggtcagtgttcgatggatttctttatccatctacaaatctaggaccaaaaagaaaaatgggtactgcagtccgcatcaccaccagtcctttgaaagagcaggaaatggaggagtttgtctaacatatctgttatgttcaacaatggtgtatatattattagtcagaatttagccttgcgctattatgatagaattagttgcctggtaaacagtgttaacaatggtgttttgtttatt

SEQ ID NO: 79377 - DNA, 382 bp, Zea mays
  Clone ID: LIB3088-008-Q1-K1-A6
acggttctagatcgcgagcggccgtcctttttttgtgtagaatctatatttggaagacaagtgttatcttcatttgaaggtcaagtctgtcaaaacaaaaaagagcccatgcatgtatgggcacaaatatttttacaaaagaatcgaaaacctggaagaacaaaagcatctcgcaggctaaaccccaagctatacctatctacacaggttcacgtttcagtatcttccgattgcgacccctactggaacaggaacagggacccaaggtttacgcatgcaagaaggctactgctattcctttacaaagagccctttgaatttgatgatgcctgccaggatttcttcaagcgaaaatgatatatatatataacccattatactc

SEQ ID NO: 79378 - DNA, 161 bp, Zea mays
  Clone ID: LIB3088-008-Q1-K1-A9
cccacgcgtccgcccacgcgtccgcccacgtttccgatccggtcacgagaggagcgtttagtaggaccagaaccggatttggtcacatcaggtgagcatctttgtctcggtcgtctgatttgactgttctaatccatgtttgctagtataatcttcttttt

SEQ ID NO: 79379 - DNA, 95 bp, Zea mays
  Clone ID: LIB3088-008-Q1-K1-B10
gtgaattgcagaatcccgcgaaccatcgagtttttgaacgcaagttgcgcccgaagccttgtggcggagggcacgtctgcctgggcagtcacgcc

SEQ ID NO: 79380 - DNA, 363 bp, Zea mays
  Clone ID: LIB3088-008-Q1-K1-B11
tgggatactgccggatatcgtcaacaattgttccagatcggagtattggatcaaatgagagtgtcagcaattgcttgttaaaaaacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaagaacgaaaaaaaaaaaaaaacaaaaataaggtacgcttttttaaaaatccaataattattcaatagggtaaccaaaattaaatttattgaacggggatttaaaacttaataactgggaaaacttttaaaaaaacccaacttagggaaaaacctgg

SEQ ID NO: 79381 - DNA, 222 bp, Zea mays
  Clone ID: LIB3088-008-Q1-K1-B12
tgggatactgccgtatatcgtaaacaatagttccagatcggagtattggatcaaatgatattgtcagcaattacgtgttaaaaaacaaaaaaaaaaaaaaaaaaaaaaataaaaaaaaaaaaaaaataaaaaaaaagaaaaaaataataaaataaaaaaatgaaaaaaaaaaaaaaaaataaatatataaataaaaataaaaaaaaaaagagacatcaatat

SEQ ID NO: 79382 - DNA, 183 bp, Zea mays
  Clone ID: LIB3088-008-Q1-K1-B2
tcgtccacgcgttcggtggagactgcggccttcctgaacgcgtgcgggctctgcaaacgccgggcttgggcctggctacaaacctttatctacaagggctaagtggcattctgccagcaggagtgccgggagaagcacatctgagtacgacaacctctacttgcgcatggagcatacctgctt

SEQ ID NO: 79383 - DNA, 283 bp, Zea mays
  unsure at all n locations
  Clone ID: LIB3088-008-Q1-K1-B3
ctagagttgaaacccaacaaaaaccatatgtcaaggttaaagcgataggctaaatctttggtatatttcattttttcaaatctcttactgcttctttatgtcaacttcgaccttcctctctctctctctttttattgctattgtgacttgaaagatgttagaacaggtattctacatttatgttcttctcatccggattgctataagttttcttcagttctgcacaactagttgctctgcangatagtgtgtatccgctttatgctaacttatatgcattttg

SEQ ID NO: 79384 - DNA, 401 bp, Zea mays
  Clone ID: LIB3088-008-Q1-K1-B4
cccacgcgtccgcccacgcgttcgcccacgcgttcgcccacgcgtccgttttttttttggtttttacttcctgagaaggatgatttcattcagctcaccatcgatacagatatacatgagcagaaactccaaaaaaaaacaggtcgtaatttacaaaactcaagacacaacaacagtcgccgaagcttaaaacgagaggttgtcctcgacgaggcagccgtcgtcgaagctccacagcggcatgtcctggtccgccgcggcggcggcgttgctctgcacggcgtcggcgctgaacaggctgtccagcgactcgtacgcgccggcgtcgaagaaggcgacccacgcgttcgtccacgcgttcggtcagaagaagcaaggaatataaatataatgttcttagt

SEQ ID NO: 79385 - DNA, 314 bp, Zea mays
  Clone ID: LIB3088-008-Q1-K1-B5
gttggatcgtgagatgaccgtgccttgggactggaacctgaggttgcaatcgggcatttgccctgggatgttggatgatcttgaggcatgcgagcctgtcgttgaagatgcaaggttacctacttgtacgacgtacgccaatgcgacctgtgtagctgtgagtagtctaatgttgcagtgacatgtaatggcgcacccccgtcctactaacagatgcttactggagattgccatagctgatcttgtaatttgttatagggcagtatgaatatatttatggtagcttgaatctatttgtggattcacttcgtttt

SEQ ID NO: 79386 - DNA, 409 bp, Zea mays
  unsure at all n locations
  Clone ID: LIB3088-008-Q1-K1-B6
cccgccgcgccgccgcccgagtctaagcccgttgacggcggccaggtcaacgccgatgggcctggctactactcctcctccgtccctgctgcgaaatctggcgccggcggccagcagggcagctccgctgctcccaaggaatcgggcttcttcgccagctgttgtgggtgcttctctggcggcgaaaccgcgagatagatagattcagtgttggaccgagaaccatggatggatggatggaacatgcatgcccagtgattgtttgcgccggtgaaagttcaatttgtccggatttattttctctgaaatagtatatgttnttttttctccatcggtgagccggtgatcttgtcaatttgtacaataatcattatatgcaaccaactgtgctttaatttgctctgatatc

SEQ ID NO: 79387 - DNA, 460 bp, Zea mays
  Clone ID: LIB3088-008-Q1-K1-B7
gcgtccacacgagagtttacggcggcccaaaccccccaaatccagttccatccgaatcggcgagaaggggaagccaaatcgatggcggcggcggcggccggcggcgagaacagcggcgcgggcgcgggcgcgggcgagggcgagttctacctgcggtactacgtggggcacaagggcaagttcgggcacgagttcctcgagttcgagttccgccccgacggcaagctccgctacgccaacaactccaactacaagaacgacaccatgatccgcaaggaggtcttcgtctccccctccgtccttcgcgaggccaggaggatcatccaggagtccgatatcatgaaggaggacgacagcaactggcccgagcccgaccgcatcggccgacaggagctcgagatcgtcatgggcaacgagcacatttcattcaccactttcaagatcggctccctcgtcgatg

SEQ ID NO: 79388 - DNA, 432 bp, Zea mays
  Clone ID: LIB3088-008-Q1-K1-B8
cccactcgtccgcccacgcgtccgtattttcctggtttagcacactcgaggttggacaggcacatctcgagatggttcgggctggaccagtccaagtaccagtgggcgctcaacgactattttgagaggaccggacaggttatcccacactttagtttctcgttcttctgtttgtagtttgtcagtcttgtttgtttcggttggatcaatatctctgattcctctctggcaggcatgtgttctttttttattttgaaaagaggaaaacctctgcctttaagaaagcaacagtatctcggatcaccagtttaccggagaaagcataacagataaactaatcctgatacagaattaaatttcaatgatgtctaaaatcatcacaccactaggcttagtgagtgtgccaagcaatgcaagggcgtgttgcttttt

SEQ ID NO: 79389 - DNA, 177 bp, Zea mays
  Clone ID: LIB3088-008-Q1-K1-B9
ggtcattgtaatgttgcgcgtatattcagttcttgcccgcgatgaaaggacaagcgatagggggccacgcattctgtatgacgcacagacgatcctgacatatgcagatcttaactctgaagttcctacgaaagaaagcgctgaaatcatagactacctgaaggcaacatatacggt

SEQ ID NO: 79390 - DNA, 465 bp, Zea mays
  Clone ID: LIB3088-008-Q1-K1-C1
acttctccaggtaaggaaagggttcgtactcatggcgccgccgcagccaaagtcgggcctcttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaagaagaaatagagagcatttcaagttcatggagcctgccagagattatgttccagtgtctgattttccatacatgtagaacctaatagacatgtcaaagtattatgtat

SEQ ID NO: 79391 - DNA, 375 bp, Zea mays
  Clone ID: LIB3088-008-Q1-K1-A4
gaacaggtgcgctccggcgttcgtgccggtcgatgtgatcggcagcgcctggagccccgagaagtactggatcccccacccgaagaccggcgtgttcggcccggcggctgtggaccccaagctggcagctggtggcgcgcctgacgccggctcggatgctgcaagaggcacggtgctggacctgaaggtgtggctccgcccgttcgaggacgtctagaagccgccctccgccgagtgagccgcgcggtgctgcatagcccagcccacactggttctcgctcacaaaaagggcagcggtagagcctggcatgcactctgctcgagctcagctgggctggactgattgcttatatcactactattctatactactag

SEQ ID NO: 79392 - DNA, 435 bp, Zea mays
  Clone ID: LIB3088-008-Q1-K1-C10
aaagaatatgatggcaagattgctgacgtttggtcatgtggtgtaaccctctatgtaatggttgttggcgcatatccttttgaagatccagaagagcctaagaacttccgcaagacaattcagcgtatcttgaatgttcagtacgcaattccagacaacgtgaacatatctccagagtgcatgcatctaatttcgaggatttttgttggcgatcctgctacgcgaataacaatccctgaaatccggaatcatagttggttcctgaagaaccttcctgctgatctgatggatgatgatagcatgagcaaccaatatgaggagcctgaccagccaatgcagaccatggatcagatcatgcagattttaacagaggccaccataccacctgcctgttctcgcagtataaatgtcctagctgatggactggacatggac

SEQ ID NO: 79393 - DNA, 119 bp, Zea mays
  Clone ID: LIB3088-008-Q1-K1-C11
aaaaaaaaaaaaaaaaaaaaaaaaaaaaaattaaaaaaaaaaaaaaaaaaaaaaggaaaaaggatataaaaaaaaaaaaaattaaaaaaaaataaataaaaaaaaaaaaaatataatat

SEQ ID NO: 79394 - DNA, 270 bp, Zea mays
  Clone ID: LIB3088-008-Q1-K1-C12
ggcgccgctcggctcgtaccggttcctcatccttcccgctctccgtatgcttatgctcttgatggtactagtttcgttgttcgcaagcagaggaagaaccttctgtagattcggttttgttgtccatgtgctcagatgggaacttgagattgtatgaatttgagatatggtgatatgagctgatgatttttattatgcttattgttgctcctctgagctgtcttttttgaacgctatccaaataaatttgaaaccagattgctgatgcgt

SEQ ID NO: 79395 - DNA, 410 bp, Zea mays
  Clone ID: LIB3088-045-Q1-K1-G2
ccagacgttagtgctgcgacttcgttgctcttgccttgtgtatatacagtatattgttacctccaccggagtttttcctttcctgctgtatcgcattcagtgctgagtgcattattagatttggaacccgttttctgttatgaattagtgataatggaagtcaggaagtgtcgcgttatgaattagtgcagggggcaagaaagccagaggattatttccgtattaaaaaaaaaaaaaaaaaaaaaaaaaaaaaaacaaataaaaaaaattaacagattttaaagcataaagaataaagaaaaaaaaccttaaaggtgaggcctttttaaaaaattttgaattatgaaagagcaatcggaacacttcccttgaccgataatttataaaaaagggggggcccttttaaaagc

SEQ ID NO: 79396 - DNA, 333 bp, Zea mays
  Clone ID: LIB3088-045-Q1-K1-G3
ccgacgcctgactccaaaccctttcgcctccgtcgacggctgatagctccagcgccctctgggacggctggccggatgtcgtcctgccgctacgagctatgcatctgcttcgtcgattcaacatgggtaagacacgctgtgtgccagttagctcgcgtgcttaagacccacacgaggcacctaactgggcctggactaaccctacaagatgagccatgctcggaacaagatgaatacaccttaccctggatcatgccactctctggcaatatgtgccaagaagagtggcatgatgagcacccaggctgtctacgatctactgatcaatgctca

SEQ ID NO: 79397 - DNA, 301 bp, Zea mays
  Clone ID: LIB3088-045-Q1-K1-G4
cccacgcatccgctgactcttacattaagcttaattacgacaacatactggggtcatttgggcaattcttagaccgaactccagccgacaaaacctttaaaacgtacctctaatagctcactctttactctgaaataaacaaaataaactactcacactatacactatcacaaccttcaatcctattatcattctacaactaactatcctttttgtctaacatatatacaattcaatcgacgcttcataacacaattttgaattaccataacattaatccttcccaacttaataatctttc

SEQ ID NO: 79398 - DNA, 428 bp, Zea mays
  unsure at all n locations
  Clone ID: LIB3088-045-Q1-K1-G5
cttgatcagtgcaacaatgagtggagtgacttgctgcctccgcttccctggacagctgaactcggacctgcgcaagctcgcagtcaacctgattccgttccctcgcctgcacttctttatggtcggctttgcgccactcacctcgcgtggctcgcagcagtaccgtgctctcactgtccctgagctaacccagcagatgtgggatgccaagaacatgatgtgtgctgctgacccgcgtcatggccgctatctcacagcatctgccatgttccgtggaaagatgagcaccaaggaagtggacgagcaaatgatcaatgtccagaacaagaactcgtcctacttcgtggagtggatccccaacaatgtgaagtccagtgtttgtgatatcccgccacgcggcctctccatggcctncaccttcattggca

SEQ ID NO: 79399 - DNA, 367 bp, Zea mays
  Clone ID: LIB3088-045-Q1-K1-G6
gccacgcattcgggggttccaacatcaagttcaatgttgcgaaagtactgcggtcacttggaccgatcctcgactcaatctgtggtggagaagaccgtgaaaccgagcctagttgagctcagcgaggaccctgacgtcaacgttagggactactcagaccaggcactgcatgcgtgcgaccagatgatggtgtcaagctaactatcctttgcgtcaagtatttagagagttcgatcgatgctccatagtccaattttggattacctgtaatttggcctttagatttgaagagttgtttgtgtctagcctcggtaacagataaaaacggacggtcctgatccccttgttcgtttgtgttaattaatgt

SEQ ID NO: 79400 - DNA, 190 bp, Zea mays
  Clone ID: LIB3088-045-Q1-K1-G7
cccacgcgtccgaccacgcgtccgaaaaataaaaaaaaaaaaaaaaaaaaggaaaaaaaagggaaaaaaaaaaaaaaaaaaaaaaaaaaaataaaaaaaaaataaaaaaaaaaaataaaagcaataacacaatgaattaagacccaaaaaaaatgcaaaagggccatgctatttacccatcaacaaaatc

SEQ ID NO: 79401 - DNA, 431 bp, Zea mays
  Clone ID: LIB3088-045-Q1-K1-G9
aaacaaacaaaaataaaaagataaaaaaaaataaaaatttataacaaaacataaaaaaaaaggaggaaagtggaaaataactaaatgggtaagagcatcaatatcaccttggaaaaaaagaagatgaaaatgacggggagcttgtagtatctaaaatcttcttccagttggcaaataagagtatggaaatttctgaaacagaaactgcttgtgaagaacctgaagcacctgcttcagtgattggtccgaaaactccaaagacaatcacaccgcagccacgtcatcctaaaagtagtccatgtgaaactcagcagaatatttccattgtgcaagatcagctactactggacagcgaatgctaacctaccatgcctattgttagtctggacgatgatgctatgaaccctgcatggtgtgctgtatctgaaaaa

SEQ ID NO: 79402 - DNA, 439 bp, Zea mays
  unsure at all n locations
  Clone ID: LIB3088-045-Q1-K1-H1
cagccaatggcaccacatggaggatgtctggcgactgcggtcctnctcgtatcgggaaccgtatgcngagtggtgttgctcaacagcgaggcgggttctggcgttgaggtgggttccagcgtcgaggcggtccccaatggtgaggacccaccgggatgcggcggggcggtgctatctgcccatcaacaagatcttgcattgctcggtcgactgcccgacgtatagaagaaaggttgaagatgtcatggtgagaggcttcaatctagccatcgttcacggcggcgacaaggtggttcaccacgaattcgcgttggtatagaggcattttcttaccattcttncttncttgggtatctcttcttcgtctggcaagagcgggcgctgataacggggttagaaacaaagaaactgaagcanatgatgaatgttcntttcattt

SEQ ID NO: 79403 - DNA, 401 bp, Zea mays
  Clone ID: LIB3088-045-Q1-K1-H10
gagccatggccttatctgcgaacctcaagtctactgcaggaaactgtccgagaaagacgagttcttggtgcttgctactgacgggatttgggacgtgctgccgaacatggaggtggtgaagtctatgatatcagcgcctgacaccttccaaagcggcgaggcagctgatctaccgctcggtctgagcgtggcgactcatgctctcgacgtgcatggaggacgactgctccgccatgtgcctgcacctgaaccggtgggcctgacctgctaccatcgagagcatcagatcactgatcactgctaccgacagacactatgtcgagcacacctttcacaatcatcagtttccgtatgactctgacgagcaactgtcccgctgtgatcgacgaggtgaccacggt

SEQ ID NO: 79404 - DNA, 443 bp, Zea mays
  Clone ID: LIB3088-045-Q1-K1-H11
ggacgcgtgggcgccgaggccacagcggctgcggcggcggtcaaggaggtgctggccaggccgaagaagcccttcaacaagcgccgccgcatcctggccaactggtccaggagagcctcctgcagctcgctggccacggccacctacctgcctcagctcttgggccccgaccacgccgtggccgaaggggacgagggcgaggaggacgactacgacgacgacgtggagtacagccaggtgccggaccacgggaagaacgtcaaggacgcgccgacatcgccactggcgctccctagactcggcggtggcggcagcatgcaaaggaggaacggccttgtgagcttcagatctcctaggaccttctcgctgtctgatctacacaatagcagtgctgatggtagagattagcggccacagatttgcttgcagctctggcctctcct

SEQ ID NO: 79405 - DNA, 232 bp, Zea mays
  Clone ID: LIB3088-045-Q1-K1-H12
actactagcacgcagttccaggcgcagagcttcggggccaagagcaagctagctcttgccgtctatacctgctcaaagagcgaggaccgatcgccagcactcgctcccgatgccggacgcctattctcaagcccccacaaccgtaaactcgccttttgcataactgctccaactatagcccataaagaactggtacctgttgccggaccttcgctactcggtctacttcttg

SEQ ID NO: 79406 - DNA, 420 bp, Zea mays
  Clone ID: LIB3088-045-Q1-K1-H2
atttccattgtgctttctccgttgcatgcagcctcgcgtctcttctcgcatctagcctccgccctcagctcaccaccacgacccgagggaaagggagaggggagtaggggacgaatggcgagctctcagtgctgcgataacccgccagccctgaacccggcctgcgggaagggcaaggtcgtcgacagcttcggcgggctcaaggcctacgtcgccggccccgaggactccaaggccgccgtcgtcctcgttgccgacgtcttcggattcgaagcgccgattctgaggaacatagccgacaaagttgcttcgtcagggtactttgttgtggtaccagatttctttcatggggatccttatgtacctgagaatgctgagaagctcatacctgtgtggctgaagtcacatactccggaaaaa

SEQ ID NO: 79407 - DNA, 242 bp, Zea mays
  Clone ID: LIB3088-045-Q1-K1-H3
gttaggacttgctaataagctgcatactatttgtttgcttgagaatccgaaaatgtcagtgctttttcatgggttgtagcatctgcgtggccccactttttacgtgactcctaagtgttttcggctttgtttacacttgtaactaacgaagaaatcctgggatgactgggtcgcaacttctttaaaagatgctattcttattatggaaatttaatcggagactgacaatttaaagtcacctc

SEQ ID NO: 79408 - DNA, 442 bp, Zea mays
  Clone ID: LIB3088-045-Q1-K1-H4
gatgagtccttatgttctgaaaactatgtcgaatgacaacaagggtttatactcaacatccttcaaagttcctgatgtctacggagttttccagttcaaagttgagtaccagaggctgggatatactggtttgtcttttacaaagcagattccagtgcgcccttacaggcataacgagtatgagaggttcataacatcagcgtacccatactacactgcctcattttcaacgatgtgtgctttcttcatattctcgcttgtgtacctgtaccacaaataaaggactcacgggagcgcacaagtttctggaggctgctgatgcgacctagatctgtggccaagtgttacccggtgcaattttatggaatcatatatttgtagtaagccaacttagctagaattagacgaccgtgaccgcaatcatgggaaatttactcgtgct

SEQ ID NO: 79409 - DNA, 70 bp, Zea mays
  Clone ID: LIB3088-045-Q1-K1-H5
attcgaaaaaaaaaaagatacaatatcgaatgctaagaacaaatcgaaaaagaaaagagaaaaaaaagag

SEQ ID NO: 79410 - DNA, 257 bp, Zea mays
  Clone ID: LIB3088-045-Q1-K1-H6
cggacgcgtgggcggacgcgtgggcggacgcgtgggcggacgcgtgggcgctttttaaagtgataaatacttagctgcaaattcagcaatgttcttgttgaaaaaaaaaacaaaaaagataaaaaaaaaagaaaagaaattaacaaaaaaaaaataaaaaaaaaacttacaagcataaaagagtatgaaaagataatgggcgtccgttttagaggactaaactttatgaacgcgaacattcaacgctatagttatat

SEQ ID NO: 79411 - DNA, 422 bp, Zea mays
  unsure at all n locations
  Clone ID: LIB3088-045-Q1-K1-G12
ctcagcatggccattctttggctagtgatcaccacacatattatcaaccagcgcttactggggagccttgacagcttcctcttgttctagagcctcgatatgttccgtcggccctagatcatcatcatgtgccaaagcttcgacatgccccacctgcatattatcgcactttggctccatctggtgattcatactatcggtctgttgagaatctggtgcctgagcgatatgcagacagaaccatggctgacttgaccactagagatccaattattagggatcacacagcactaccaggggaggcacttgctcgagcagaccgcttggatgatctctaccgttctgatcgtgtggaggaactctaccgttctgatcgacttgttaaccgtgctgtggaccgncctcatncaacctattttaca

SEQ ID NO: 79412 - DNA, 82 bp, Zea mays
  Clone ID: LIB3088-045-Q1-K1-H7
cccacacgttcgatacgagcaagctgcttgttcaatagcacctagctaggcgtagctactgggttgtacaatatatctaagc

SEQ ID NO: 79413 - DNA, 320 bp, Zea mays
  Clone ID: LIB3088-045-Q1-K1-H8
ctagcttcacaggaacttgtttttttaccagttaccgacaaattggagggccttcgacctggaagccctggtttgactggtgtagttcttggaaactacagtgagatattgccacttatttcttctgtcatgcggtgcatccttttgtgtcgtggcattttacgcattattaacatagttaacatgaggcttatgaaagataagtacccatactacactgactcattttcaacgatgtgtgctttcttcatattctcgcttgtgtacctgtaccacaaataaaagactcacaaaaaacgggcaacctttttaaaggttcc

SEQ ID NO: 79414 - DNA, 268 bp, Zea mays
  Clone ID: LIB3088-045-Q1-K1-H9
gcgtcgctgtgtgtgtttcgagtcagtcagccagttagttgcgtgccatggctggcatgctctgagtctgagatgatgatgatgcctgacggcggcgtctggtactgtagtcctgccctgcccaatcgggcgcttctggcggcgagcagtgtgttgtgtcgtgtcgtgtggctgcagaacattaacacgctagccatgtaccatgctgtggagtgttaccatccatgtataataatcttatatgtataccccaaattacgaaaacaat

SEQ ID NO: 79415 - DNA, 233 bp, Zea mays
  Clone ID: LIB3088-045-Q1-K1-E6
cccacgcgttcactgacacgtcggcggacacgttaaacctgaagcatgtgggcactttcagggctttataatcctaagccgtggacaccatgcaccttgcatgaactaacaagctttgaacactgatacgactattctcatcatctcctgcgctaacaagcacttcactgatcgtaatctaagcatcttcataggcatactactactagtacttgctactgctgattttacac

SEQ ID NO: 79416 - DNA, 444 bp, Zea mays
  Clone ID: LIB3088-045-Q1-K1-E7
ggattcttccacactcggagtggtgattgtcaagcattgtggatatacagcaactgtgaaggtttctggacgtgcaaaggacagtaatgatgttaaacaaacacatgacatctctgataattttgatggaatgctgaacattgatgtgcctgaccatccagatggaggttctaatgccttgaatgtcaacagtctaaggataccactccaaagtgttacgcatccagaaactgttgttggtaagcagaaccctagcccaaagtctcatgctaataaccccgcaaggaaactggcacgtaaaatacttgaggacagcttggtaaagctggatagcatgcctagcataaattctagaattatcagatgggaacttgggtcctcctggctacaacagttacagaaaaaggattctccagcatctgagaatgttaagcggaatgcaac

SEQ ID NO: 79417 - DNA, 115 bp, Zea mays
  Clone ID: LIB3088-045-Q1-K1-E8
cgaagggatacgacaacaacttaagatgaaggttcaggcacacgacttgtttcggttgcaccccgtgatggtcagcatcggatgcagaccatttcatcgatctcttgtgaatttt

SEQ ID NO: 79418 - DNA, 421 bp, Zea mays
  Clone ID: LIB3088-045-Q1-K1-E9
caaaatctgcaccagaaccaaatttggttcggcacaatgtagcctgcactgctgatcgtgatgggtacctgtactcactgaatgcttccactcttagcaaacagtgggaatctatggggccctttctacaaaagaccgtggcatcctttcgccttctccccggtacagaaaactatgttcctccctacaaggatccttggagattttggtgaatggagattcttcttgtagtcatcatttctatcccttcagatgactttatagcttcaggtattagaccatatttttcacgtcagatgtttactgagtgcctgtcctttcaggttgacagataaaattcagagacccaaattggtatcagtttcacccatcgtgatcgttctgattaataacagtcccagactaaaggtgtgtttgaaaa

SEQ ID NO: 79419 - DNA, 268 bp, Zea mays
  Clone ID: LIB3088-045-Q1-K1-F1
gcgtagcacatcattaacttcacgccgctcatcgacaagaaggcgtggtcgtacgtacagagcgaccttcggctacgggccttgtacctgcgctacgacctctagaccgtcatcgctaccaagcccaaggaggagaataagagcctcaaggagctcaccggcaagatcttcaataccatcgacgatcttgaccatgccacggagatcaagagcaccccataggccgaaaaatacttggcagcaaccaaagatgctcttggcgatgttc

SEQ ID NO: 79420 - DNA, 398 bp, Zea mays
  Clone ID: LIB3088-045-Q1-K1-F10
accactcctccgcgcgtacgaaaacgcgtttgacacagaaaaagctgaaacgaaagctaaggaaaatgcgatagataaaaaagcaaaaaaagaaaaaaataaaaggggcggacgatttaaagggtccatacttacaaactcttaaatgcgactgaatcactttcttatagctctacttatatatatttcactggccttaattttccaaatggtctacttgcaaaaccgtgtgatacccaacttaatagatttgcctacttgcctatttacccgattggtgcattagcatataggtcaacctctatggccatttccaacagttgccctaactgatcggcaaatggtacgctccttgctacgttgcttatagcgcagcttgtgtcataggttctcgcacc

SEQ ID NO: 79421 - DNA, 399 bp, Zea mays
  Clone ID: LIB3088-045-Q1-K1-F11
cgcgctggggctgccagacatcggccagattttcccggtactccgacccccgttggaaggtgaccgattcttcggtgttcatgagggaagctgtgaaattgatgcatgaagcaggctacgagctgggcaaccttgatgctacgctgatcttgcaaaaaccaaaaattagcccattcaaggagacaatccgatcgaatttgcgcgacctacttggggcagatccatctgtggtcaatctgaaggccaagacgcacgagaaagttgacagtctacgggagaacatgagcatagctgctgatactgtagctctactgatgccaaagtgcaagagccacttgtgctggtcattcgatcatgctactccgatgacgatggtatctcatactggtgattctttga

SEQ ID NO: 79422 - DNA, 303 bp, Zea mays
  Clone ID: LIB3088-045-Q1-K1-F12
aacataagtaccacgagtcactgcactgcttgcatagagaagggactggaaggtgatgaagtacaagcgctgtgcactgatgtgcatgctgtcatgtgtaccgattctttcataggtacatgaacatactgtcaccaatatgaactgttacatgcatgcagatgaagcttacatatgatccatgtacggtcatactaattgaaaggctgactttattcaagtcctccctcagatctaactactgacatacggactactaattctactgactgccattgaacaatcagtatctcaagacactga

SEQ ID NO: 79423 - DNA, 331 bp, Zea mays
  Clone ID: LIB3088-045-Q1-K1-F2
gcgagagggcctaatcgccacctcaaacatcgtgacaaaaacatgaagtcctggggttattgttaatctggtgccattgtaaggacatatgagtagggttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcaatgctgtggccgatttgttcgttaatgtcaagaattgtgttacagtgcgtgtaaaaaaaaaatactatcaaaaaaaaaaaggtaggatag

SEQ ID NO: 79424 - DNA, 355 bp, Zea mays
  Clone ID: LIB3088-045-Q1-K1-F3
cattgggtttgatgacttcggtactggtgtgccctgatggaaagacgatcgaagctgaagctgcccatggtactggtacccgtcattaccgtgttcaccacaaaggaggtgaaaccagtacgaacagtattgcctcaatctttgcgtggacaagaggacttgcacacagggcaaagcttgatgacaatgctagactacttgacttcacccagaagcttgaggctgcctgcgttggagccgtcgagtctgggaagatgaccaaggaccttgcccttctcgttcacggatcttcaaatatcacgaggagccattacctgaacacggagcgagttcattgacgctgatgctgacgagc

SEQ ID NO: 79425 - DNA, 463 bp, Zea mays
  unsure at all n locations
  Clone ID: LIB3088-045-Q1-K1-F4
cccacgcgtccggcattgtcacaggggatatcgacaataccgacaaggtgctcaatgaagaatttggttctctgaatttcagtgagaagggaaatgaagataccttcgtgtcaaaccaagggttagaatatcctatggaacactcagcaggagccagtagaaagaaatcaggaaacagtgagagattctctagcagtctgttagatggaaatactaaactggttagccatgaagtttgtactaaaacactgtactatcttagtcggtttgaccggatgaaagacgcttgggacaaagatgcaaatagcctaccaaggagggctgttggtacgatggaaatgataggaaaagcatctgcaattcgacatgccgaaattgctgagttggacaaanagattaatactctgaaggaagagattctggcgctagaggcagcttgagaaagggaaatctcctgagtgaa

SEQ ID NO: 79426 - DNA, 262 bp, Zea mays
  Clone ID: LIB3088-045-Q1-K1-F6
cggacgcgtggggagtcatttttggcatgctcatcgccctgccgatcacgctcgtctactgcatcctactcggcctgtgaccgtctcatccccaattccccatggaggacgccacccactgcattgctgcaactgtaaagaccactgctgccgtcacttcccgttcatgggagacatggccagcaaggacgggagatagaactgctaccacattggccgtcgcttgcagactagtggcgtgtactatctctctctatctatc

SEQ ID NO: 79427 - DNA, 396 bp, Zea mays
  unsure at all n locations
  Clone ID: LIB3088-045-Q1-K1-F7
cccacgcgtccgcccacgcgtccgcagctgttattgtgaggcagcgcaagccatggcgccgaaaggatggtgtctacatgtactttgaagacaatgctggagtgattgtgaacccaaagggagagatgaaaggttctgccatcactgggcccatcggaaaggagtgcgctgatctctggcccaggattgctagcgcggcaaatgcgatcgtctaaaggaagcagtttgtcgaagtttcatttaaaatggggactttagaagggagttcttagttagacgagcttttgattgccctgaatatgtttccccggctaatgcttgtgctgctggaccgtttcctgatagctttgctttgatgacatcctncccgttatcgataaagttgcgtagcctgac

SEQ ID NO: 79428 - DNA, 306 bp, Zea mays
  Clone ID: LIB3088-045-Q1-K1-F8
aaaaaaaacacaaaaaaatataaacaaaaccataaacaaaaataaaaaaagcgaaaaacacgctaaattttaaactacaaaataaaataaaatacacaaaaactcaaaccgacggcccaacatctcctatcgaacactcatccggatcctgtcaacaaacatcagtctacattgatatcttctctagcagtctgttacctggaaattctaaactgcttagccataaaccctgtactaaaacactgtactatcttattcggtttgacccgatttaagacgcttgggacaaagatgcatataccctac

SEQ ID NO: 79429 - DNA, 433 bp, Zea mays
  Clone ID: LIB3088-045-Q1-K1-F9
acaatgatggccaaatcgactacagcgagttcacggcgatgatgaggaagggcaatgctggtgcaacaggaaggagaaccatgaggaacagcttgcacttgaatctcggcgaactcttgaatcccagcaaaacctagcgcgttactggaaggccttgtcaggtacattcccatggcatctgaagtttttggatgcgttgtcggtctgctggcctattctgagatgttgagtggttatcctgtggtattactaagatgctggacaattttcgtagtgctggtggtatcagctagagaagagggatggctggcacaatgtggctactatggccaactgcttttgtatgtgtaactgtcgatgtagattgactatggtctaaacatcagtttagttgatatttcgttctctaaattcctcgataactgctttttac

SEQ ID NO: 79430 - DNA, 330 bp, Zea mays
  Clone ID: LIB3088-045-Q1-K1-G1
cggacgcgtgggaaaaaaaaaaaaaaaaataaaaaaaaaaaattaaaaaaaaaaattacatggaaaaaataagaaaaaataaaaactacatattcttatagaatacaatgctcttactgatcgtgaacttcaaaaggagagatctattgtatctgtcatcactaatcccattaactaagacgtggctttatatcttgcccagcattgctaaccctgcatatgccatcctctataggatgcaagctgatgaaccttcatttaaaatgtgtactttagaatggagttcttagcttgacgagcttttcattgctctcaatatctatcccctga

SEQ ID NO: 79431 - DNA, 386 bp, Zea mays
  Clone ID: LIB3088-045-Q1-K1-G10
cccacgcgtccgggcatcatacgtgaagtcggctgccccaacagttgtgaagagaccattggcacaggacactcctgagctgacagctatggttcctgcatcactccgtgtcaagagagaatctgctctccccaagccaaaaccaatggtgcagcagcagccacaactatcaacagtatccatttcaaagccctcggtgaccctcataagaagcgacgctgggactccttcaacggcacccaagccgacaagcatcaacgactcttacatggcgtccttggaagatatgacggagctaagtgcacttgatgggtaactcacgtcgagcacatgcctgactgcacttaacagctgaattcatggaaacctgcgcatggaacctttaa

SEQ ID NO: 79432 - DNA, 433 bp, Zea mays
  Clone ID: LIB3088-045-Q1-K1-E5
cggacgcgtgggtccggaggctggcgaggaggggcggcgtgaagcgtatgggcgggcttatctacgaggaaacccgcggcgtgctcaagatcttcctcgagaatgtcatccgcgacgcggtcacctacaccgagcacgctcgccgcaagaccgtcaccgccatggatgttgcgtacgccctcaagcgccagggccgcactctgtacgggttcggtggttgagcgcatctcttccctcgtctgcagcggctgccggtggcgtttcctcagttccctctgccttgcttggcttgatgtagagagttatcagattaaaatatctctgatgtgcttcgttattgggtggaatcatgtgtcccagcagtgctgggaaatcgagatcaagatgtatctttctttgcagtaatgaaatgttaaaatcgagatcaagatgt

SEQ ID NO: 79433 - DNA, 402 bp, Zea mays
  Clone ID: LIB3088-045-Q1-K1-G11
agctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaagatggagttggttgatgctgcgtttcctcttctgaagggagttgttgctacaactgatgttgtggaagcctgcactggggtcaatgtggccgtcatggctggtggattccccaggaaggagggaatggaaaggaaagatgttatgtcgaaaaatgtttcaatctacaaatcccaagcatctgcccttgaagcccatgcagctcccaac

SEQ ID NO: 79434 - DNA, 360 bp, Zea mays
  Clone ID: LIB3088-045-Q1-K1-D10
cggacgcgtgggcggcggcgatgtctgggcgcggcaagggcggcaaggggctgggcaagggcggcgcgaaacgccaccgtaaggttctccgcgacaacatccagggtatcacgaagccggcaatccggaggctggcgaggaggggcggcgtgaagcgtatctccgggcttatctacgaggaaacccgcggcgtgctcaagatcttcctcgagaatgtcatccgcgacgcggtcacctacaccgagcacgctcgccgcaagaccgtcaccgccatggatgttgtgtacgccctcaagcgccagggccgcactctgtacgggttcggtggttgagcgcatctcttccctcgtctgcagcggc

SEQ ID NO: 79435 - DNA, 191 bp, Zea mays
  Clone ID: LIB3088-045-Q1-K1-D11
cggacgcgtgggcaggcaccttggtggcgactccatcgtggaggtgatgccctctgaaggccatcttccccagcttagctctcccgacattgtaatccctgtcttactccgacacatccagcatgatatcgcagtctaggttggtcaagcgttcctccaaggcgatgagcatccgaagctgtctacttgtc

SEQ ID NO: 79436 - DNA, 412 bp, Zea mays
  unsure at all n locations
  Clone ID: LIB3088-045-Q1-K1-D2
cccacgcgtccggcgccccgtagtgcagtgcagtgcagcagtgtgctacctcctcagtcctctcactccgtgcacaaacgctagtcttcctctaaagctcggagcgagtctcagaagcgatggcgtccaagaggctgctgctggcggcgctgtgcgtggtggcggcggcgctgctcgccgtgcggtcggaggcccacggcctggaggacttcgcaagcagcgacgcgacgccggagatgcagaccttcttcaagcccgaggccgcggcgctcccggaggccctggacgcgtcctccatgcccgccgncaccatggccgcgaagccggaggccacgtcgatcccgaccaccaccaccggcaccacggcggcggcggcgggcacctacgccgcggcaggcactactgctgcgtc

SEQ ID NO: 79437 - DNA, 214 bp, Zea mays
  Clone ID: LIB3088-045-Q1-K1-D3
ccgggcatgtaaatccagctgtgcaaggtcaaggctacatcaacccccaggagcgtaacatcttcttgcgggggcacgcacgaggttctaggcctgctggaccttcatcacctgggtcttatcgcctaccatcagcacctggatactatggactaccttatacacttcctaactatgatcgggtacctacatctatgcatcctagggggcacaa

SEQ ID NO: 79438 - DNA, 374 bp, Zea mays
  unsure at all n locations
  Clone ID: LIB3088-045-Q1-K1-D4
cggacgcgtgggggcgtacttcaaccatggaggcatcctcccttatgtcatccgcaacttggcagctgcgcataactgatgcaaggtcaacacaccgtttgacccacaatggcagtggcaggctccatgttcccagggctagcgacctggttctcaatgtagtgacatttgtgatggatctaggggtctctttgtcgattcagcccataaataaagtgtgaaataaaagccgcaagtggaggcaggaacctgctgattgagggaacagatttgcctgtgtttggttacatgaaatatctgtttcacagatgtgtacagcatgcgtgtaaatgcttcctgtgctgatacttntgncttcgacaaattgattatgc

SEQ ID NO: 79439 - DNA, 447 bp, Zea mays
  unsure at all n locations
  Clone ID: LIB3088-045-Q1-K1-D5
gacgcagaggatgcaatccgtgacctagatggcaagaatggatggagagttgagttatctggtaatgccagcggtggtcgtggaggtcgtgaccggcatggtgggtctgagtccaagtgttacgagtgtggtgagactggccactttgctcgtgagtgccgtttgaggattggttctggaggtctaggcagcggaaggcgccgaagccgtaaccgtagccgcagtcgcagtcccagatatcgccggagtccaagttacggtagaaggagttacagtcctgcagcacgctctccaaggcgtcgtagcgtctcaccagctcgtggacgcagctatagcaggtcaccacagcacaagggtgcacgtgaagaatctccctatgataatggataccgncgcagcaggagctagagccagatcgttgtatccgacgacgagcgttatgtgaca

SEQ ID NO: 79440 - DNA, 425 bp, Zea mays
  Clone ID: LIB3088-045-Q1-K1-D6
gggaagcgagggagctcacgcggcgccatggacgaggaggagcacgaggtttacggccaggaaatcccggaggacggcgacatggacggcgctgacgttgatatggctgcctccggcgatgacgcggcgaagctgcaggagctcgacgagatgaagcgcatgctgaaggagatggaggaggaagccggcgtcctccgcgatatgcaggccaaggtcgccaaggagatgcaaggaggtgaccctagtgcatctacagctgatgcaaaagagcatgtggatgcccgttctgtgtatgttggaaatgtggattatgcttgcaccccagaagaagtgcaacagcatttccaagcttgtggaactgtcaacagggtcacaatcttgactgacaagtatggacagtcaaaaggttttgcttatgtggaatt

SEQ ID NO: 79441 - DNA, 374 bp, Zea mays
  Clone ID: LIB3088-045-Q1-K1-D7
cgcaacagttcttaaggcccatatgcatgctctgaagaaaagggagaggaaagacaagaagaagactgcagatgctgagaaggcaattgagaccgcacccaagaagcagaagaaagcatcttcaaagaaatcttcagggtccaagtcataaggcgctcacagaactcagtgtgtcttctcctttatgttgtttaccgccagactaattagagtgtcgtgaagttttacttatctggtttttattcgaattcgtgtctggaagatgaaagcctgtgaatacacctttatagagccgtgtcatcgatgctaacattttttgaagcagagttttgaagtgaatgtgaagcgctgtgctgccctgattggcattaacg

SEQ ID NO: 79442 - DNA, 349 bp, Zea mays
  Clone ID: LIB3088-045-Q1-K1-D8
ggcgatcgagcaccgccatggggcaaccaagaacagagctcctcgccctcgcattccttgtggtcgccctcgccgccgccgtggccgccgcggcgacagaggtggtagacgcggcgccggcaccagcgaggacgaggacgacgacggcggggtgccggcgcggcgacctggtggtgcggcagcgggcgacggggcgcgtggtggaggggaagcccgagtacgcggtggaggtgcggaacgcgtgccggtgcgcgcagtcccgcgtgctgctgcgctgctaccggctcagcagcgtagatggcgtggacccgcgcgctatacgggcccgtcgacggcgagcgctgcctgc

SEQ ID NO: 79443 - DNA, 443 bp, Zea mays
  unsure at all n locations
  Clone ID: LIB3088-045-Q1-K1-D9
cggacgcgtgggaaaattagctacgaagaatttgtagcgatgatgaagactggaacagaggggaggaaggcgtcgcggcattattcaagagggcgcttcaatagccttagcataaagcttataaaagatgggtctgtaaaactgggtagcgagtgaggttgtagcttgctgccgatgctcttctcctccacgcattgtagtctgcctctcgggcccgctaagcagaaacccccttccgtttgctaatgattattttgtctgggatttaggtagttggagcctccctgattggtttactcgtgtaattagtatcccttttcagtatcgctgaggagcatctgctgtaggatgcacgcctgcctncgtctgtctgctcatctcctccggtgtacccgtcgctcaaatggaagtgttgtaaaatggtttggtgttgacctcaaatg

SEQ ID NO: 79444 - DNA, 440 bp, Zea mays
  Clone ID: LIB3088-045-Q1-K1-E1
cccacgcgtccggacagccaccatttacagttgcgtgatgtcaaggtgcaaaacatcgagagaggcaagggtcattctgtactccatatagaatatcctgattggcccgaccatggagtggcaactaatacagatgctgtacgggaaatctggaaacgactgcatcacattccaacggaacatcctatagttatccattgcagtgcaggaatcggaaggactggtacttacatcacaatccatactacaattgagcgaattcttcttggagataaaagctcttacgatcttgccaaaactgtaaagaattttagatcccaacgacctgggatgggccaaacagaggaacaataccagttcttgtacaaggcaattgctgacgagcttgaagacctgctaaattcagatcattgaggtgggtcacatgagacggacagcaa

SEQ ID NO: 79445 - DNA, 436 bp, Zea mays
  Clone ID: LIB3088-045-Q1-K1-E11
gagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaaagtaacatggaaagtttcacatcaaaccttgagagccagaggaagcatgtcaccatttgtgcttt

SEQ ID NO: 79446 - DNA, 420 bp, Zea mays
  Clone ID: LIB3088-045-Q1-K1-E12
cccacgcgtccgaaggtattaacatcaatgacaacaaaaaagcttattatgaaaacaaatggcatgttgtatctaactatactaattttgtgtcactaatatgtcttttttctatagaattcagtcaaaataaaaaatttaacttagaacaactctagaaatggatttgttcaagcaggagccaggagggaaatgatctaacttgatagatgaaaggcttgctcttttagatattttgcttcaagattttactaaaggtacttccaaatttgtcacaggttgagattgtgatgagtctcgaggagcacttcgatattagcgttgaggagtccagcgcacaaacaatcgccacagttgaagacgccgcggacctcatcgacaagcttgttgctggcaaagcgtagttctgtaccttctcta

SEQ ID NO: 79447 - DNA, 435 bp, Zea mays
  Clone ID: LIB3088-045-Q1-K1-E3
atcacgcatggcgttctcgcgactacatgcgttctcgtcgtgctgaactgcctaatcatgttccaaacttactacatgcaagtgcttgacagctttaagaccttctacaccaacgtgaaccaacagaccgtgctctacatgggtaccgctaggcttaagagtgttatacagatggatgttgcgtacgctctaaagcgccactgccagtactctgtacggcttgcctggctgatcgcatgtcttaccttgtctgcaaccgatgcctacgccggctccacatgtaactgcgtcttgattggcttgatgtagagagttatcagattccaatatctgtgacgtgcttcgatattgactggaatcatgtgtgccatcagagctgggaaatcgtgatccagatgtcaccatgttcagaaacatgagatgttaaaatctaaa

SEQ ID NO: 79448 - DNA, 390 bp, Zea mays
  Clone ID: LIB3088-045-Q1-K1-E4
cccacgcgtccgccggaacatcactggcaacccggaagtcagggtaaacaaggcagggagggcagctggtgtgcttgagaaccatgaggaggggagacgttacgccatgcatggcctaagaagctttgtgcacgacaagactcctgagatcatgcctgcagttaacaagttcttcactgaccctaagtgaagcatgttgattggcatactactactactacttgctactggggattttacactttgctggcaactcaatatgttggggacatccatgacctctaaaagtactttgagcgcttggtgatgacttggtatatgtatgatggtggatgagtttgatcgtccatgcttgatgttcatattcatctgtcatctggatttgccgca

SEQ ID NO: 79449 - DNA, 450 bp, Zea mays
  Clone ID: LIB3088-045-Q1-K1-D1
cccacgcgtccgcccacgcgtccgcccacgcgtccgcccacgcgtccgcccacgcgtccgacgagttgctgcagaggtacgagaatgtacaaagaagcttcaaaataaagaaggcgatgctatccaaccatcgaaactataggacttcatacgaccgcctctttgaacaggtacgtagactggaaaccgaaagcgatagcctaaagaaagatgccgccatctacaactttgtgcaagagcgtcttcagaagtcagcgccatacaaaatgatcatggagctgagtgcaatggagctggaggctcaagaaatatcgttcgaggagcttctggctcgtgagaaggaggacaccgactattggcagcgcaacgggaaggatgagaacagtctcgtgcaagtaggacacaatgcccctgctacttgggctcactgacgataggagacctaacatc

SEQ ID NO: 79450 - DNA, 199 bp, Zea mays
  Clone ID: LIB3088-007-Q1-K1-G9
cccacacttcccaaaaaaaaacaaatactttaaaacacatacaaaacactaaatgggtaacgtaaaaaagaaaaataaaactaaaaaaaggtcaaccatttctaatgccccattcttacaatacatctacttgcaacgtctccacttctagtatagcttctccttatttcaatcaattgcctgtccttttacaacactg

SEQ ID NO: 79451 - DNA, 405 bp, Zea mays
  Clone ID: LIB3088-007-Q1-K1-H10
gacactcgtcacggagaaggtgagagagaatggccatcatcatatcacctgaaagtgagcttgatttttcagcagacggactggatacttctaggatctcatattatgaactcatcttgacatgactgcaagggtgcatactctcactggttgtaacaactgatactatagctatcgaattacacaatgtgcaggaatagatctcagtctgatgaagccatactagactaaaacattcgtcctaactaaccagactcatgcaaatgtcctgggtcatgccaaaatccatgtcatacacctgcagtggggacaagaccttaccgacagataccctggcatctcatgtaatcaggggtgttcagaatactgtctaaattgaaagcacattccatagaagattacatt

SEQ ID NO: 79452 - DNA, 230 bp, Zea mays
  Clone ID: LIB3088-007-Q1-K1-H11
cggacgcgtgggcggacgcgtggggtgtggtttgctcgttagagcttattttcggacatgcaaaaaacatgcttcctatgtgggatgatggttatctttatatttgtatgttaattagtctctttgctgttaaaaaaaaaaaacaaaaaagaaaaaaacaataaaaaaagcaatagaattacacaatgaacaaaaaattgatcgtaattagatgaaaaaataccatgaat

SEQ ID NO: 79453 - DNA, 418 bp, Zea mays
  Clone ID: LIB3088-007-Q1-K1-H12
cccactcgtccgcccactcttacgcccactcgtcctgaaactcatgcatttgtattacagaaaatttaaaaaaaaaataaatgatataataaaaataaaaaaatataaactaaaaataaacataatttaaaaaaatacaaaaaaaaaaaaaaatataacaactaaataaaataacaatctaattacacaaatgaacaaaaattgaatctcaataatataaagccatccctttacttaaaatcccattttaactaaccattatttaaacttatatccttttttattctatactccaaataaaacaccttcaatgtttacaaaaactttcctactgaaaaactttcatctaatccaatctaaagtgttcaaaataatttccactttttaaacacatttcataaaatataacattcttttc

SEQ ID NO: 79454 - DNA, 439 bp, Zea mays
  Clone ID: LIB3088-007-Q1-K1-H2
gttcgacttcttcagtcaagcagcaatcatgcaacatgccttactgtagttttttatcactgcacatgttgctggataaatttatagactggaggattatagaggactaacaagtgctactgggagattctcgagcaccattgaactaagagattccaaatagttctttggagtctattgttgatgttggcggggataatctagcagagatttgtcagattttttgtgcaacacggaggctacatgaggcagcaacgatcccattcttctcgcatgccactttacacaagctaaggatagcttctggtctcactcatggttgtggcagggaaagccgagtcagtagggtttgtcatgtagctggagttatctcagaccgcatattagatgcagtgatgatgtttacatttaccgtgcaagcaagatgacttatattatg

SEQ ID NO: 79455 - DNA, 448 bp, Zea mays
  unsure at all n locations
  Clone ID: LIB3088-007-Q1-K1-H3
cccacgcgtccggtgcaaaacatcgagacaggcaaggttcattctgtactccatatagaagatcctgattggcccgaccatggagtggcaactaatacagatgctgtacgggaaatctggaaacgactgcatcacattccaacggaacatcctatagttatccattgcagtgcacgaatcggaaggactggtacttacatcacaatccatactacaattgagcgaattcttcttggagataaaagctcttacgatcttgccaaaactgtaaagaattttagatcccaacgacctgngatggtccaaacagaggaacaatacaagttctgctacagggcaattgctgacgagctgaaagacctgctaaattcagatcattgaggtgggtcacatgagacggacagcaacgctgntagcatttattacgtttttttagacatttctatgt

SEQ ID NO: 79456 - DNA, 122 bp, Zea mays
  Clone ID: LIB3088-007-Q1-K1-H4
cccacgcgtccggcgacgcgtacgctctctggccaggttcgatatgaccggaatgtagaggattctgggtgctccatacatgctaacaggacttatacagaaacagctcgggcattgtagct

SEQ ID NO: 79457 - DNA, 420 bp, Zea mays
  Clone ID: LIB3088-007-Q1-K1-H6
cccacgcgtccgttaagtatggacgactttcgctactgaagctacctgggggctaatgaggatttgatcgcgcttttgtggtgtcagttcaacactgacacttacatataatctccatataatccctcgccatactaactgcatgagttctaataatttttcaagcatcactcactgtttatatactacgctataacttagcagagatgcaagatgttacgtacatcatatactcgatgtctgtacgctgtgctgagttagtgtacgagctgaatcgaatgcatgactgtgtatatgtatatagatgaaaacatccacatggaatgtaatacggaaaactaaatctccaactgatcggtttaaacgtctagaatatgcaatattaaacactcgtgcattagagctcgtacgtatcttata

SEQ ID NO: 79458 - DNA, 432 bp, Zea mays
  Clone ID: LIB3088-007-Q1-K1-H7
ccaaggtggcggaggcgaggcactgcctgtcgcagagccaccggttcaagggcctgtgcgtgagcagcaacaactgcgccaacgtgtgccagaccgagaacttccccggcggcgagtgtaaggcggagggcgccacgcgcaagtgcttctgcaagaagatatgctagtagtagcctcggctttgctggcacaagcaggtcgtcggcacgcaacgcaattcaagcatcatatcggtcctcctcccgcgttgctgtctactcgaccccgttttctctttcgatcgatttcgttggttcctgttgctctcttcttttcccgcgaataatatgctccatgggatctcactgttgtactttctgcatccgttggtagtcaggacgatccttcttcccgctgtcacgtgtgattcaaaatggatgtactaatgcaact

SEQ ID NO: 79459 - DNA, 443 bp, Zea mays
  Clone ID: LIB3088-007-Q1-K1-H8
cccacgcgtccgaaaaaaaaaactaactttaaaaaaaaccaacaaatcaagggcctatgcgtgaacaatcaacaactgcaccaacatatgccaaaaacgagaacttacccagcagcgagtgtaaagccgaaggcgccacgcgcaagtgcttctgcaagaagatatgctagtaataaccttggctttgctggcacaagcaggtccgttgcacacaacgcaattcacgcatcatatctgaactccttacgcgttgctgtctactcgaccccgttttctctttcgatcgatttcgtagcttcctgctgctctcttcttttcccgcgaataatatgctacatgggatctcacttgtgtactttctgcatccgttggtagtcaagaccaaccttcttcccgctgtcacgtttgattcaaaatggatgtactaatgcaactgttcgttc

SEQ ID NO: 79460 - DNA, 419 bp, Zea mays
  Clone ID: LIB3088-007-Q1-K1-H9
attattatgatacgcgtcattgtaggttagctagctgttccttgtaccattaatcagaagttcattcatgcatgaattgacaacctgtcattgctttcgtttctggggttcaagtaaaatcgtttgactgcttgacgagttcagtgtcggtgttgccatgtaaagtcgttcttgtaatagtgaatgaatagttcccggttggaactagtggttttttacactgctgaaagccatcgtggttggcaataatgtctcatggtcaatgaaacgtgaaataattctgcctgtaaaaaaaaaacgtggtaacaaatctcaacaagctggtggagctaccaaaatgatccatctgaagttactcagaacaagatgcaatcacagattgattatctttcgctgaaataaaaaaggggcttccgttt

SEQ ID NO: 79461 - DNA, 321 bp, Zea mays
  Clone ID: LIB3088-008-Q1-K1-A1
tggacgcgtgggcttctccacggaggaggttatgcggaacgccatcgagggcatgaacggcacggagctggacggccgcagcatcaccgtcaacgaggcccagtcccgcggcggacgtggaggcggcggcggcggcgggtacggtggtggccgtggaggcggcggctacggcggaggcgggcgccgtgatggcggcggcggctacggcggtggcggcggctacggtggtggcggaggcggctacggtggtggtggcggaggctacggcggtggcaaccgaggcggcggctacggaaactccgacgggaactggaggaactg

SEQ ID NO: 79462 - DNA, 439 bp, Zea mays
  Clone ID: LIB3088-008-Q1-K1-A10
cacaggctgaccccaccaacagcaagcgaaaatctcccgatcccctctagtctccgcggcgaagatgtcggggcgcggcaagggcgggaagggcctgggcaagggcggagcgaagcgccaccggaaggtgctccgcgacaacatccaggggatcacgaagccggcgatccggcggctggcgcgcaggggcggcgtgaagcgcatctccgggctcatctacgaggagacccgcggcgtcctcaagatcttcctggagaacgtgatccgcgacgccgtcacctacaccgagcacgcgcgccgcaagaccgtcacagccatggacgtcgtctacgcactcaagcgccagggccgcaccctctacggcttcggcggctaggctaggccggtcgcgcctcgttgtcgtcgctgcggttctattgtttttgcaattcgcaagttg

SEQ ID NO: 79463 - DNA, 423 bp, Zea mays
  Clone ID: LIB3088-008-Q1-K1-A11
cggctgccgcggcatccggataccggatgctcaaggtcgctccaccggccgtgactgtggccgcggttgcgcagagcgactccgactcgtcgtctgtggttgatcactccccttcgcctcccgcggtgacggcaaacaaggtgggcttcgaactggatctgaactggcccccgccggcagagaactaggcaggccggagtttttggctgacgacttagtagcttccttttcccttttgccttcatcaggaatgttacttgtggttgttttggtcctgtatggctgtattcttgttctgtagactaagagatggggagtcttgtaaatatttttttccgtcgagacggaaatgaactgagatctgttcgtctgtctgatcaagccggcgttgatatgggcttaagctatggagtattgattagt

SEQ ID NO: 79464 - DNA, 434 bp, Zea mays
  Clone ID: LIB3088-008-Q1-K1-A12
aaaatgaaagagaataacaaaataccgaatgctaaaagacagatacaccaaacgagactgagggcgcagatgcacagagcgactgcgactcgacgtctgtggatgatcactccccttcgcctaccgcggtgacggcaaacaaggtgggcttcgaactggatctgaactggcccccgacagcagagaactaggcaagccggagtttttggctgacgacttactagcttccttttcccttatgccttcatcaggaatgttacttgtggttgttaaggtcctgtatggctgtattcttgttctgtagactaagagatggggagtcttgtaaatattgttttccgtcgagacggaaatgaactgagatctgttcgtctgtctgatcaagccggcgttgatatgggcttaagctatggagtattgattagtaattgcca

SEQ ID NO: 79465 - DNA, 279 bp, Zea mays
  Clone ID: LIB3088-008-Q1-K1-A3
aaaaaaaaaaaaaaaattaaaaaaaaaatttttaaaaaaaaaaaaaaaataaaaaaaataaggacccgtttacaaagggtaatggtaaaaactaatttataaaatctaaaatttatgtttgcaaaaaagtactaaaaaaaaacaaaataaataaaaacaaaatcttagaacttaaaaatgactcactatctaaaggttcaaagtttaatctcacatcatttacaatgaaaacctcttttatctggagacctaaattaaaatcattgtccttcattttaa

SEQ ID NO: 79466 - DNA, 453 bp, Zea mays
  Clone ID: LIB3088-007-Q1-K1-G8
cggacgcgtgggcctgattacacagtgcttgcgtttgctgacatgatgaggaagaagagcacgatgccagcccatctcatgtacgacggtaaggacgacaacctgttcgagcacttcagcgcggtggcgcagaggctgggcgtctacaccgccaaagactacgccgacatcctcgagttcctggtccagaggtggaaagtcgcggagctcacagggctgtctggagaagggagaagggcgcaggactttgtctgtaccttggcgccgaggatcaggcggctggatgatagagctcaagcgagggcgaagcaagcaccggttattcctttcagttgggtttatgaccgcaaggtgcagctttaatcaagaacgctaggcaatgtgggcatttactacgtatatcattttcagtcctggggttctctataagaaacagtctctaggttatctagc

SEQ ID NO: 79467 - DNA, 411 bp, Zea mays
  Clone ID: LIB3088-007-Q1-K1-F2
cggacgcgtggtcagactcgtgggcggactcgtgagctgacacctgacgcgttctacgcttcaattgggactggactgatccacaccaggcacttgagtaggagtatgcggcatttgaacaggcaatcatgctagctagacctgattagatagacagcgttcgcttccatgtcaaatcatggacacctacaaggtctattgcacctgacgagtcgttcaccacctgcaactgggaaacctgtgtcgaaccaaacatcattggcaagtgtaagatccctgatgcgccatgtatcagcacctgatgggaaacctttgactaatcacatagcacaagctatatgcaagacccataatgaggcagaaaacagctgagcgttgaaggcctcagatgatccaattacctgtagcaga

SEQ ID NO: 79468 - DNA, 460 bp, Zea mays
  unsure at all n locations
  Clone ID: LIB3088-007-Q1-K1-F4
gcttccttgtgctcgcatccctgctcctcgccgtcgcctttcccgtgtctgctctgcggcagcaggtgaagaagggcggcggcggaggcggaggcggaggcagtgttagcggaagcggaggcggcaacctgaatccctgggagtgctcgcccaagtgcgggtcgcggtgctccaagacgcagtacaggaaggcctgcctcaccttatgtaacaagtgctgcgccaagtgcctctgcgtgccaccggggttctacggcaacaagggcgcctgcccctgctacaacaactggaaaaccaaggaaggagggcccaagtgcccctagaagatccaccgcagctcccgtccgccattgtcccctcttctccgaatctggaacgtgttgntcatcttggaccaccccctaggcttggcattntattactagtataatgctagtgtccgcccattgcttaatctgga

SEQ ID NO: 79469 - DNA, 319 bp, Zea mays
  Clone ID: LIB3088-007-Q1-K1-F5
cggacgcgtgggcggacgcgtggggcagtttagctgggggagaggatgtcctgagcctgcagattcacagttttgttgaccgtagaaaacgtttattcatttattagttacaagcgtccttaccccccccccccccctctccttttgtaaaagtagtgcatatagcaggattaagataaacacatgtaatggagtatatattgtgcaactgccatatattatatgatatatagcggctcatattaggttgccgaaaaaaaaaaaaaaaaaaaaaaaaaaaaaaaaaaaaaaaaagggcggacgattttaaggaaccaaa

SEQ ID NO: 79470 - DNA, 246 bp, Zea mays
  Clone ID: LIB3088-007-Q1-K1-F6
ctgactcgaggatgtgctcgtcacatatttgactttgtaaagaagatttagtgtaacgggagacaagaagtattggagatgattgaatatgttaattgatttgctagttagcagaggtgcaatcatccaattatgaatgatgttttgtaatagcctagtatataggatgattaagataaacatatgttatgacacatagtatggatcgactgccatatgttatatgatatagagcggttcatatta

SEQ ID NO: 79471 - DNA, 446 bp, Zea mays
  Clone ID: LIB3088-007-Q1-K1-F7
ggaagtcctacagacgatctggccgccgttagtgcacctcagagcatgttgatggttgggacatgaagcctgttcgcttccagctatcgacctctgacgggcagcaggcattgtctcagtgctacctggaggagcccggtagctgggtcctgtaccatgctggcgattttgtggcctcaaagcctgaccagctgatgaagctgaagttctgcatggcacagatcgactgcacgcacacaaaatgcgggctgtgcatcgactcggttcttatctatccaaaagggaaggggtttcaccaggagagggtggtcaggtctcagaaatgagggttgtagatgttgtggaggtattcacattaggatgttagagcaaatgcagcttgcagtctgatcttatttttactttgggctctagttcgcagcaaaagtgaagtgtatgtggttgta

SEQ ID NO: 79472 - DNA, 373 bp, Zea mays
  Clone ID: LIB3088-007-Q1-K1-F9
agggcggttaacatgccatacacatcttttactgcacgggccagccaaatctgcggccgcatgggctaggtgtgcacgcatcggcaagggcaacaagccgcgggtgagcctgcccaagggcaatggtatcaagctcagcatcgataaggagcagatgaggcacgactttgctgcccacgctgctgacaaagcataagtcttgtgaatgacgctgctagcagctatgtgctataacatagtatatgaggatctgcacggatataaaactacctgctcaagacggtttatcataatgttgaatgcgctttggataaaaataccaagacgtaggacatacgccccttcctttcttctatgctgaattatgggtgaa

SEQ ID NO: 79473 - DNA, 400 bp, Zea mays
  Clone ID: LIB3088-007-Q1-K1-G1
cggacgcgtgggttcgcgtttagaacctctaaaatttctcccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgactaggagctcgggaagctgctggc

SEQ ID NO: 79474 - DNA, 431 bp, Zea mays
  Clone ID: LIB3088-007-Q1-K1-G10
ccacccatggcagaactgacttatgactatggtgttgctggagctgaatctaggggttcaggttctcgtagaacgaagaactgcgtgtgtggatcacaaaactgcaggggattattttgatgggttgagagacgtgtctttgtggttaatcatgcaaaccactttctgctagatcctttctatgaaaccaaatttagtctccggataatatgacagatgatgtcatttgccatgtgtactgtgaagacagtaagttgtcgagcgagctgtagaatttctgttgctctgcactgcatggtggtcgctttcccaccatttcctcggatgtttatgggggcgggcattgctgcattgcttccgctaaacttgtccaccaattgcaccggcttttgtagacttgttatcagccccgcttgcgttggacgcctggt

SEQ ID NO: 79475 - DNA, 331 bp, Zea mays
  Clone ID: LIB3088-007-Q1-K1-G11
aactgagcccatgcgtcgtgggagcactgcggctgccagagcaccttcaaagcggcgtgagaggagtgaccggcccaaggacactcgtcttcagccccagtcaacagagcacaagcgacggctggtctcctctcatggaacaaggtcaaactcagatagaagggaccatgggcattcttatggggcatactgacagggcctcagttgacttccttgaggttcattctactaggaagcggatgcccgttttctcccgaagttagtatgatggtagacaaatcggtggtgatcgaaaacggtccagggagtatgatgactcgtgaggagcacg

SEQ ID NO: 79476 - DNA, 400 bp, Zea mays
  Clone ID: LIB3088-007-Q1-K1-G12
agccgacagctgcctgctcaagaacgccaaggagcggcccaccatgagcgagggggtcgaggtcctcaagcgggccgtgcacgctcacgccgagcctgactgacggactcccagcccaggcgccagggggaagaaagccgacgccgccgactccgacgcgccgtacagtcggcgatggctacatgtattcaccgataaaggcacgctgctgccttattgctgagaccattgttaggtcagtgctagccgtgactcggtgagttgatattgtgacagcacataaggaatgtctatgcttgggtacattcttggacacattgcttagacgactagtgtacatatagatgagttggcagattgaactttgtttagctttctaaagtgagcatttcgcaagaaa

SEQ ID NO: 79477 - DNA, 367 bp, Zea mays
  Clone ID: LIB3088-007-Q1-K1-G2
ccagagttgaggtcccttttcaatggacgtactaggtgctgtggacgacatctgctatggtagataggcgcatacatgtctgcctataaatgctaactctgcaatcaccaacggaaaacacaagagtactcttggaggaaaggttatcattcactctaacaaaccttaccaacttatgccttgtttgaatgcaattatgcatgttcttgtaccctgctcttgcttggacacatgcttgacatggctaaaaaatatacctcgccgacgtcctggagtacctcgccgcccaggttctggagttggcagggaacgcggcgaaagacaacaagaagacgcgcatcatcctgcgccacgtgcttctggcgat

SEQ ID NO: 79478 - DNA, 359 bp, Zea mays
  Clone ID: LIB3088-007-Q1-K1-G3
ggactaccctgagaagccaccatcagttctatttcattcaagaataaacttaacatgcggtaatcatgaaactgtagtggttgacccgaagaagttcagcgttctgggtaactggcagcgtgattactcaatggaatacatcctaacccatctcaagaaagagatgacatcgccacagaaccgcaagctagttcagcctccggaagggacattctgctaaagatggcagcaactcatgtccatccatggtgactcggaaacagctttcgcacctggttcctatattttatatatttatgtctgatcttccagttatcttgtatactcacctagatcgagtgcaagcagacttggttgat

SEQ ID NO: 79479 - DNA, 432 bp, Zea mays
  unsure at all n locations
  Clone ID: LIB3088-007-Q1-K1-G4
cggacgcgtgggcggacgcgtgggcggactcgtgggctaagacgagggctaccgcaagggcagttaggcctttaccaatcaccgtctccagatctgccaggaggaggacgactggaagcgcatcgaggaccgaatcggatgcgggcaagtcgaggagctcatcgaggaggccgaggacgagctcaagctcatcgccaaaatgattgaatgggatccgtggggtgtccctgatgactacgaatgtgaggtgattgaagacgacaccccaattcctaagcatgttcctcaacaccggcccgttgctcttcctgaggagttcttcaagacactagatgccgtcaaatcagatcccgtccttcaaggcgatgctcctnctcatgtgaaagcgtaaagatgagtcttcccggttatgtctaatgtcatttcacactt

SEQ ID NO: 79480 - DNA, 458 bp, Zea mays
  Clone ID: LIB3088-007-Q1-K1-G5
cccacgcgtccggcataataaagcaatctccagggatacatgggcacagttattggagtgtgttaagacaattgatcctcagctaaccaactatgacgaagaaggtgcttggccctacctaatcgatgaatttgtggactacttgaaagagaacggtcttgcctagcatagaaggtgtacggaattgggctgtaggggggagaatttgtcacccacaaggccaccatcattgtataacttaatggttggatgcttgtattcattgcactaccaatagctaatgcggctcgtgcgtctggggatggagtttatcctctatatagacaaaacttgttgaatgatgtgggtgtaaaacgaaggctagaatggaagtcaagccctggttatcgccattttgaattcctcatcacgtgcctcgcctacgtcattgtgactttgcaaaaaaaaaataaaagggc

SEQ ID NO: 79481 - DNA, 419 bp, Zea mays
  Clone ID: LIB3088-007-Q1-K1-G7
caggttatgataatatcaagcgcccgcactccagcaaggctgactgccgccgtcgagcagtatctcatggaacacggccttctgtacacgcaggtgcaaccaggcctgctccgcatcctgctctagtaatggaactggtcgtcctagctgttgttcacaactggatcagatgaaaaagaagggaaaaagaaaagaaaagaaaagataagttgacctgtacttttgtatatggcagagattgctagcaggatagtagcgttaagaacttaagatagctcatgtaacattcatgtcaggctttttgtcagcaaatgtatacgtcttaaaatttgggagttagggaatattctcgttgtctatggtgccggtggatgcacacggcatagcgtcttcacagaatcacaatcatattctcgatc

SEQ ID NO: 79482 - DNA, 435 bp, Zea mays
  unsure at all n locations
  Clone ID: LIB3088-007-Q1-K1-F12
ctcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgncctcggtgtgctctccatggccaacgccgggcccaacaccaacggctcccagttcttcatctgcaccgtcgcgaccccttggctc

SEQ ID NO: 79483 - DNA, 378 bp, Zea mays
  Clone ID: LIB3088-007-Q1-K1-D6
cccacgcgtccgatgatacgtttatcttgtcgttctcctactcttcctaccgcacctccgtgcactcttccgtatttttagcctaatatttcaggtcaaactgccatacttcatagctttttgctcctcattgttttaagtgaaagggctccaactattcaaaatttactctaggtagataattttcattgacgagttttattttggtatatgtaactttttgtaattgggcctaaccgtattgtagcactctaatttaacatgtgctataagctgatgatgaaattatacagcttggatgaataaacctttactgtagttacatatagagtttctaaattacaaggaattttaatttacctaactttatcttcttat

SEQ ID NO: 79484 - DNA, 434 bp, Zea mays
  Clone ID: LIB3088-007-Q1-K1-D7
ggcattggaagccacatatctgagcgacttctgattgatggactaaacaggatgggaatgaacgaatccattgtgagaagagctcttctgattatgcatcaaagagacgaggtggagtacaagagagagcgccatgtgatcgtccggaaggcttgatgtggagagtccagtcagactcattcatggcatacaacgaacgttcatggcgtcctctcctcagacgcgtccataccttcactgagactgcacatctgtccgtcctgaggggacgagacacgccttagttggtctctgacatgactgactgttgtaatcagcaaacggcttgagcatgtaggctctgtttttgaagtgaccaaaggttctgattgaacctgtagtgtaccgtgtaactggtcaatcaattctgaaatgcaaaatttgtgttcttcggc

SEQ ID NO: 79485 - DNA, 162 bp, Zea mays
  Clone ID: LIB3088-007-Q1-K1-D8
cgcatgcattgtgtagatttttatatacatatctgtacgcccttgcaatggagagggcgggacatgtgcaacacgttgtggatgaacgggccaggatgctgcttaggtgtgatctatcctatccatccatggataataaagaagtttgtggattgctgtttt

SEQ ID NO: 79486 - DNA, 405 bp, Zea mays
  Clone ID: LIB3088-007-Q1-K1-D9
cggacgcgtgggtgaggatgaggatgaacaaactgttgagcagcagccagaggaggtcgggacgcaggagcaacagctcaatgagctcgtggacatccaaatcgaggagattgctggtgtcgccaagaacgtcactttacgtcgcatggataagatggcagagctggtggttcaatgaatctgggtgaggttcctacttcaaacgatgttaaaatgctgacgaagcttatctggtgaggtctctgttatggttcggcttcttggtagaaagggaatgtttggttatcgcactgacatcgtaatgttagaaccaacacatgcataggcactgagtacattgtcacggcagattattatgtactgcaattctcgaatatttgatgtgaatgctatgttagattgctt

SEQ ID NO: 79487 - DNA, 355 bp, Zea mays
  Clone ID: LIB3088-007-Q1-K1-E1
acgcccacgcgtacgcaaagggccggccggtgtctggagaagctggtgcgcactgtacctagggcccagtgcccattcaaaaaagagaatgcactaactgtcagacatgctgctgaaatgggatgatggataccgcgacacattgcttacactgatacacatacatgctgtactgaatctgctgagccaaatcagaagcagatgattacaagctggtagctaggacatgagcaccctttgtggggtattcttttatggtcctatttgattgtatgtatacttataggaatgaaggcaaacacacctaagcagcatgtgtgatattcccatgtgctaataaagaaaatggcttgtt

SEQ ID NO: 79488 - DNA, 310 bp, Zea mays
  Clone ID: LIB3088-007-Q1-K1-E11
aaaaataaaaaaaaaaaaaaaaattaaaattaaaaaaaaaaaaaaaaaaaaaaaagagaaaataaaaaagggatcaaggcactacacatgtcacctaccatcaattcgcatgcattcacctgtctgttctgtttgactctgtactcttcggttctccaaatctccatttcttttacaactttcttattcgctaattcccttaccttactcagctccttacattttcaccatttcccctttctgtcacttgctttactagccataagcgccttattgtcttccatttttatcatttgctcctcctaattgc

SEQ ID NO: 79489 - DNA, 418 bp, Zea mays
  Clone ID: LIB3088-007-Q1-K1-E12
cggacgcgtgggcgagcaagcgcctcgttctcgccgcatgcctcctcctccttgccaccgtctcgggggccaccgacgtcgactactgcagtaagaaggactacccggtgaaggtgagcggggtgcagatcgtgcccgatccggtcgaacccggcaagcccgccactttcaagatctccgcttctactgataaaaccatcgagaaggggaagctggttatcgacgtcaagtatttcttcttctacgtgcactcggagacccgcgacatctgcggagagactttcttgccagcgaccggcgacttcgtgctggtccaccagcagacgctggcaggcttcaatccggcgggcttctacacgatctacatgaagattgtccgggacgacaaccaggaactgaactgcatctcgttcgggtt

SEQ ID NO: 79490 - DNA, 411 bp, Zea mays
  Clone ID: LIB3088-007-Q1-K1-E2
cccacgcgtccgcccacgcgtccgtcgcgagcggccgtcctttttttttttttattttggtttttttgttacaaccataaagatcagcactaacattaatgactttgctaacataagagtgtcataccatgcgtgccatacaaactacaggtacattcatacatagcataacttacagcacatgatacaagctacagagcacggtcaatcttaaatatataaaaaagacaatattgaaggctctgatgatggagagaaaccagggcaggctttccccgcaaatacggagaagctacttccaaccagtgaccttgtgaccggacgcgtggggttacggacatgtacccaaacgtgatccagttttagttaatgtgctccatgcttgacgtttaaaaaaaaaatttttttttt

SEQ ID NO: 79491 - DNA, 453 bp, Zea mays
  Clone ID: LIB3088-007-Q1-K1-E5
cccacgcgtccgcccacgcgtccgcccacgcgtccgcccacgcgtccgcggacgcgtgggctttgcggccggtctctgctttcagattcatttctaaccagggttcctccagcccagccgccgccactgttgaggagctcacatcgcctcgacacaacacggtctctggtttcaacgtataataactgggctgcgagcactatatggatgatggcttcacgaggcaccagtgccgtgctttcaagggctgctcggatgaggcaaaaactgcagtctgccttggaggccagtgccctagatattgaagacgtttcttaccaacatgccgggcatgcagccgtcaaggacaatgcgaacgagacgcacttcaacatcaaggttgtttcaccaaaaattgaggggcagaacccttgtgaagcgtcacaggatggtgtatgatcttctgagggatga

SEQ ID NO: 79492 - DNA, 457 bp, Zea mays
  Clone ID: LIB3088-007-Q1-K1-E6
cggacgcgtgggcagcaaaggatttagatgaccttctcttagcacacgatgaatatctgaactcgatactggagaaggccctgcttggtgaacattcccaaggacttttgaggaatctgtttgaactgtttgacattattttacagtttcgaagccatgctgatcgatggtttgaaaggatatatgagttgcagctaaggggaaagggtaaatcaaaatcaaaggatacaggttcatggtttgatggcggcagaaaagctatgatccaactagctggagaacttttctggaaaatgggtgaagacctggatagcatcgcaaaggattatacagcttctcttgatgcttttattacgcagctgcccatgcaacagcacgtcgatttgaagttccttctcttccgccttgacttcactgaatattacagtcgtgtttccttcaacaaatgaatgtgagc

SEQ ID NO: 79493 - DNA, 312 bp, Zea mays
  Clone ID: LIB3088-007-Q1-K1-E7
cgcgagcgtccgcccttttttttttatattatttttttttattatattatttatttttggttttttttttttttattgttttttttttttaatatttttttttttttttatttattttttttaatttttttatattattttatattttaaaaaaaaagctgatcaaagtttaaaaaaaaatattagaaaaaaataaaaataaaggttaaatcatttatcaaaaaaaaaggtttataatttgatgaaaaaaaaataaatatgattcaactatctggaaaacttttaaagaaaaataggtatgacttagaatag

SEQ ID NO: 79494 - DNA, 453 bp, Zea mays
  Clone ID: LIB3088-007-Q1-K1-E8
caatgttcttagaccttctaaaagatgagaatgatggcattgccgcaaaagattggatagtcccctacgatatcttcaacgttacaagcagcatttaacagcccacagtcggacagattgaaacagtcactggaaatggcacctcgctttcttactttatattttgcaacagcattgcgagacgttaatgactcactgctgtgtgctcttattccagtagttatgtcaagatatgctgcaatgttcccagacaaagttttctctttcaaggtgagggaaaggctttcagacttcattttggctgcattccagcggtctcccaacatcattgcagtactgaagaaacctattactgacagacttggtgaggctcatgataatcttgccaagacagagttagcattgcacttgtgctgggccattggtgagcatggagcttgaggggtgggtcac

SEQ ID NO: 79495 - DNA, 436 bp, Zea mays
  unsure at all n locations
  Clone ID: LIB3088-007-Q1-K1-E9
cggactgtccggtgtgcaccggactgtccggtgagccaacggtcggccgggccgacggtcggccgcgcgatcggcgcgcgacacgtggccgagccaacggtcggaaggaagcaccggactgtccggtgtgcaccggactgtccggtgcgccagatctgcaacggtcggcaacggtcggatgcgctgtttaaggaaacaaatcaggcaccggacagtgtccggtgtgcaccggactgtccggtgcgccacgagacagaaggcaaagatggccttccagatttgttcccaacggctcctagctgccttgnggctataaaagggacccctaggcgcatggaggagcacaccaagcattcctacaactcttctaagcaccaagacatcaatctcacgcattcgtttcattgtgatagcatatagagctcttgtggagttg

SEQ ID NO: 79496 - DNA, 362 bp, Zea mays
  Clone ID: LIB3088-007-Q1-K1-F1
tgttagatctctcaacagtgtgattgatgcaatccaaatgccaacagaccaaagctgcgcatccaatggaaggcccctgatgaaccatctgccagtctatagaaatgaacggccccaggtgaaccaaacaccataagtaacccgagtgagccatacaccggttgcaaccatggctaaccatagaccagtagcccatggaaggcacctggcgagccaaacaccacctgctgatgggaaacctgtgacgaaccaaacatgagtagcatatggaagatccctgatgagccaagtaccagcatgcttatgggaaacctctgacgaaccatatagcagtgccaaagggaagacccatgatgaggcac

SEQ ID NO: 79497 - DNA, 435 bp, Zea mays
  Clone ID: LIB3088-007-Q1-K1-F10
gatgggtttgagtgatcaggacattgttgccctctctggtggccacaccttgggaaggtgccacaaagagcggtctggttttgagggggcctggactacgaaccctttggtctttgacaactcttacttcaaggaacttctgagtggcgacaaggagggccttcttcagctcccaagtgacaaagccctgctgagcgaccctgtcttccgccctcttgtggagaaatatgctgcagatgagaaggcattctttgatgacttacaagaagcccaccttaagctctccgaactggggtatgctgatgcttaaatggtccatatcctggagcgggacacaaactgctggctgtatggactcgtgcgattcaaggtgaaccatcagattgtctagtgtcttctttgtaataaatttatctggtcttggtactttgtcta

SEQ ID NO: 79498 - DNA, 428 bp, Zea mays
  Clone ID: LIB3088-007-Q1-K1-F11
cccacgcgtccgctagatcgcgggcggccgctcgcccacgcgtccgggaatccgggccatccaagccagagccaaggcagagaagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttactcggctacatccccggcatcatctacgccatctacgccatcaccaagaacaactagctagtcatccttgccgacgacgatccatgtctctgcatctgcgtctgttcatatgcctgatgccgacttgtgctgtatgtaattgcttgaattcagtcgtgttttgctaccgtacccactccatgcatcatc

SEQ ID NO: 79499 - DNA, 353 bp, Zea mays
  Clone ID: LIB3088-007-Q1-K1-D5
cccacgcgtccgcccacgcgtccgcccacgcgtccgcccacgcgtccgccgacgcgtccgcccacgcgtccgtatttttagcctaatgtttcaggtcaaagggccatacttcatagctttttgctcctcattgttttaagtgaaagggcgccaactattcaaaatttactctaggtagataattttcattgtcgagttttattttggtatatgtaactttttgtaattgggcctaagcgtattggagcactctaagttaacaggtgcttgaagctgatgatgaaattatacagcttggatgaataaacctttgttgtagtgacataaggagtttcgaaattacaaggaatttt

SEQ ID NO: 79500 - DNA, 427 bp, Zea mays
  unsure at all n locations
  Clone ID: LIB3088-033-Q1-K1-F9
ggggggnggggggggggggggggggnnggggggggggggggggggnggngggggggggggggggggggggggggggggggggggggggggggggggtggggggggggggtgggggggggggggggggggggggtgtgggggggtgggtgggggggggggggggggggtgggtgtggggggtggggggggggggggggggggtgggggggggggggggggggggtggggtgggtgggtgggggggggggggggggggtgggggggggggtggggggggggggtggggggggtggggggggggggtggtgggggtgggggtgggggggggggtgggggggggtggggggtgggggtgggggtgggggggtggggggggtggtgggggggtggggggggggggggggggggggtgggggggtgggggggg

SEQ ID NO: 79501 - DNA, 392 bp, Zea mays
  Clone ID: LIB3088-033-Q1-K1-G10
cccacgcgtccgagcttctcaagttccatgggtgggagctgcccccacgatgcgctcgtgttctgcgcatcagcaccatgcttttgaagaaaggtgcagctcgtggcttcacaccatatgacatagggcgcattctatgcagggaaactgtgaatagggagtctgagattgaggacatcattcaggaagcagaggatgctgttctcccagggtccagtgaaaacatgttcttagaaactgtatctgaaatcatggaccgtcacctcgacaaggaatgagtttagaaattcagaataactgatctagttgttccagttccagctgtatccggtttagttgtttctattgttggcaagcactggtcaacagactaataatttgatttgtttgta

SEQ ID NO: 79502 - DNA, 198 bp, Zea mays
  Clone ID: LIB3088-033-Q1-K1-G11
ggtaaatgcgcatttcaccgtcaccctgttaccctagcggttcttggctgcttctgtccgtgctaagaaaaattcctgttggaagctaacatggatctgttcaaagaagcgtatttcgagcgtagccgtagctgatgtcttatgtagacacttgtgaagattatgtggtcatgtggcaatgcagatgttattaccttc

SEQ ID NO: 79503 - DNA, 453 bp, Zea mays
  Clone ID: LIB3088-033-Q1-K1-G2
gccaaacttgttaaagattgtgaaatgacggctccagagacaactattctataccctaatgcaggtggtaacatccacacattcagagccatcacaccttgtgctctcttcgacgtcctttctccgccatactccgctgaggatgggcgacactgttcatacttccgcaagtctcaaatgaatcaaccatctgttgttttgcctgctgagatagatagcacacaagtagtttggttggaggagttggaggaccatcagcccccagaaggctttgttgttgcaagaggtatgtataaaggccctgtaattaggagataatttgctttggggcacagaatccaccaaactgcaaatcagctgaaagacgatgcatgcttgtagtgtctattgcaagcattctcaggtcatgtgcagcctacggtttactttgtacaatgtaaagtgacctgtgat

SEQ ID NO: 79504 - DNA, 160 bp, Zea mays
  Clone ID: LIB3088-033-Q1-K1-G4
gcggagaggcgcgcgctgcccaacgccagggttttgatccatcattctctgtgctgtgcgcgtggtctggctactgtcatctggatctcaggccaattagattctcaagctgctctaccgtcttaacaagatctaccagtagtcacacactccagcccat

SEQ ID NO: 79505 - DNA, 375 bp, Zea mays
  Clone ID: LIB3088-033-Q1-K1-G5
aaagcgcatcgcatccagagatgcagagttatatcgatgcatgtatttctaaagggagagctgaatttgaagtgtttgtcctggcttattctcctgaggaatgggaactggctacattggtgctcacacgacctaattatcagattaagttcaaacagaccggttatgttgctattgacgagaagtactcacaaagtctacagacaaaaatttcaaatgggcgcacaactcagtttgttttaataactgcgggtacaactctttcatttaacacacatggaatttcatagccaaacaatgaggatttctatgttaggttacgtgatctaatcgtattagtcatgataacttttcagaaaaaggctctagatgcct

SEQ ID NO: 79506 - DNA, 164 bp, Zea mays
  Clone ID: LIB3088-033-Q1-K1-G7
tctggagaaaggcgtcccggcactactcgagttggaggttcaacagtctcagggtgaatctggtaaaggacgggtcggtaaagctgggtgtctagtgaaaaccgtaccgactctcgttcttgtgtgtgtgtgttgtgtgtgtgttcatgtagttttaggtcctt

SEQ ID NO: 79507 - DNA, 282 bp, Zea mays
  Clone ID: LIB3088-033-Q1-K1-G9
cgcagttccctgcattgcagtgttcagtgtgcttctgggaatctcagatcaagttgtggcgggcagtcagagagatggaaagaatttgtacacagctagattcgttgggctcatctgcatcctggttactttccctagaacaattcggaacgttcctgtaaagttagaacagaggtttccatttccctgagcggctgagcagaactggttcgaagacaatggatgcaggccgtatccagtgccgattcttttgctgataccacattcttccgttatgtgtcc

SEQ ID NO: 79508 - DNA, 334 bp, Zea mays
  Clone ID: LIB3088-033-Q1-K1-H10
cccacgcgtccgcccacgcgtccgtgcactcgtccgcccacgcgtcctcaaaggacgtgttgcggctgcatgggagaacggaaacctactggacatggtcgaagagtgcttatcaccaacatttgattgatgcctgaatatcaatatatcggtgtgacatggtgttgatgttcaggagccacacatgctcattgccaatggagttcactcctgtctttcgagaaccaaaatgccttgggtgttaagtgacgtgttgcatgattcttttcctccgccccgttcagttaatatatatgctactatggatctacccttttggacgtttttggtgctt

SEQ ID NO: 79509 - DNA, 438 bp, Zea mays
  Clone ID: LIB3088-033-Q1-K1-H2
agaactcttcctacttcgtagagtggatccccaacaacgtgaagtcgagtgtgtgtgacattccaccaattggcctgaagatgtcctccacattcgttggcaactcaacctccatccaagagatgttccgccgcgtcagcgagcagttcacggccatgttcaggaggaaggctttcttgcactggtacacaggcgagggtatggatgagatggagttcaccgaggcagagagtaacatgaacgacctggtggccgagtatcagcagtaccaggacgccactgccgaggatgaggagtacgaggaggaagaagaagaagaggaagagacctaagtcattctccgcaatgcttggtacagatatgatattccttgtatcgctgttagtactcgtcagtttgaggttcgtgtggtgatgcttgctaggtactagatggggt

SEQ ID NO: 79510 - DNA, 289 bp, Zea mays
  Clone ID: LIB3088-033-Q1-K1-H8
cacgcgttcgaaaagaaaggaatgctgcgtatgaatcatttacctattcttccgaattatatgtatccgcgagattaatttgtggtttcgatgtgcaaaatgaaaccatttctattggaaacattcctattatgaattccttaggaacctttataataaatggaatataccgaattgtgatcaatcaaatattgcttagttctggtatttactaccgttcggaattagaccataagggaatttctatatataccgggactataatatcagattggggaggaatgtttga

SEQ ID NO: 79511 - DNA, 318 bp, Zea mays
  Clone ID: LIB3088-034-Q1-K1-A12
gttcggtttgtttcaaagatcttttttccaaacatctattcggatggaaacatctgtttgggcatcctacaaaaccagcggagccctatatatgatgtttctgcaatattgacctctattcaatccctgctgtgtgacccaaacccaaattctcctgctaactctgaagcagccacaatgttcagcgagaacaagcgtgtgtacaaccgcaaagttcgtgaggttgtggagcagagctggacatccgactaaaactttattcgcttcgccaggcggtgtaaataaagcatctgtctttcctacttggccggtctgttt

SEQ ID NO: 79512 - DNA, 251 bp, Zea mays
  unsure at all n locations
  Clone ID: LIB3088-034-Q1-K1-A6
atggatcagacaagtttctactccgtgatgtcttgtatacatagtgtgtcagccatnaccaantnntttttgcatccaagttggaaactgcaccagtaaccaatgttgatgttgatgtcaatgcatcagagctttttaaagaaaacggaaatagcgctttcaaaagaagacagtggatcaaggcaattgagttttactcaaaggccatcagtttgagtgacacaaatgcaacatattactgcaacagatca

SEQ ID NO: 79513 - DNA, 436 bp, Zea mays
  unsure at all n locations
  Clone ID: LIB3088-034-Q1-K1-B12
ggcaggcaaggaaggagaaaaggcttgcttagaatacgactccaacaaagagagcagcgcgaaggaattcagagggtgagagtgctccgttgagctcattcaagaggcgacggcagtctcttatggacgattatgtgggctcgggaaggcgaaagagagggtgatgtgatgtttgacatcctgcctttggagctctcagcgagatgcagtctctgcaatgctttaagcccgtacgtgctgtgcttagtttcttgtgcacgtgagttgaatgcctcaagggctggtgactttgtagtgtaagttatgcaacgatgacatagattagttattataaatcctaaatgaggtatgtatgcgcatgctgtattgtagtgctgtagattcngacttcgcaattgcaactggtgcttcacttttggtcaatgatgatgccttt

SEQ ID NO: 79514 - DNA, 297 bp, Zea mays
  unsure at all n locations
  Clone ID: LIB3088-034-Q1-K1-B4
gcaaaacatatactaataatactagtaggtcattttttggagtcactctatccttcatgaggtgagtcatcataagtgcatatctatgaattttggtnnaatcaatcactcctcatttaaaaaaaaaaaaaaaaaaaaaaaaaaaaaaaaaaaaaaaaaaaaaaaaaaaaattttaaaaaaaaaaaaaaaaaaaaaaaacatttttataaaaaaataaaataataacatctatataaatataattttaatatattaaataaattataaattttattccccccttttatataataaaa

SEQ ID NO: 79515 - DNA, 331 bp, Zea mays
  unsure at all n locations
  Clone ID: LIB3088-034-Q1-K1-B5
tccgaggtttcccaaaagttaatgttcctgtatttgctgcatcggatgaggaacctgaanttggggtaggtaataaggaatgtcggcggttggccacatccggtgtgccttttttttttccattaaccaaggtgggtcggcactacatcgttgatgccacctcagagaaagaatcccagatgagttctgcagtgtcggtgtcagtcaacaggcatggccagatatgcgggcttaccaaaaggggaggggcatggcttgatccaaacgtcatcttcgacatgatatctgtcgccaagcatgtgagccagcaattcatctccctcttggattc

SEQ ID NO: 79516 - DNA, 268 bp, Zea mays
  Clone ID: LIB3088-033-Q1-K1-F8
cggacgcgtgggcggacgcttgggcggttctcgtgggcggcagatgtttcgccttgaggggctataatgtctagatgatggccactggtcaagacctgctttataattgatactcttagctgatgcttgtctaaacgacgacgatggtacctgccttggttcacaattctgattctttgtaagagtttacctagtgctgaatgcctacacatactggcacatctttgcaacattgcctcattaatatgctcgctcaattgttgatttg

SEQ ID NO: 79517 - DNA, 262 bp, Zea mays
  Clone ID: LIB3088-034-Q1-K1-B6
ttaaaaaaaaaaaaaaaataaaaataaaatttttttttaaaaagaggaaccaaaaaaacaaggttttttttataaaaaggggggcggccgcccccttcactttttcccttctttttttccctccccccctacttgttagctctttttttttaatcccaaactaaaatccactttccctcatcttttcatccactttaaatctcttaacccacccttttcccaccttaatttcttaacaacacatccccctttcccctttttt

SEQ ID NO: 79518 - DNA, 303 bp, Zea mays
  Clone ID: LIB3088-033-Q1-K1-D5
tcgcccacgcgtccgtccacgcgttcgcgcactcgtccggtgtgaagacgtactgcaactgggccaccttccccgggctctacgacaaatcgtagctgattgggggatgtgatatcgttcttgagatggataatagcggatagctgaagtcgaccctgtcagagtagacacctagctagcattcttgctttgctggcgtttttatcacattgtctgcattggatcactctactctggtattcatgccattatattcatagatccactttggtactagttctgcattgccacattgctagaatt

SEQ ID NO: 79519 - DNA, 69 bp, Zea mays
  Clone ID: LIB3088-033-Q1-K1-D6
aaaaaaaaaaaaaaaaaaaaaaaaaaaatttaaaaaaaaaaaaaaaaaaaaaaaaaaaagggaaaatat

SEQ ID NO: 79520 - DNA, 341 bp, Zea mays
  Clone ID: LIB3088-033-Q1-K1-D8
tcgctcgtcggactctgctccgcgagggcgcttaccgcagggaacgcccagctgtctagggggagatgtacgatcgaacagggaagtgccactaaacatgtgctggataagggtgccagcaacatggtagcagcgtgtggggaacctgaggagctcccattataattgaagaatctcttggagagacagcagacgaggtaggggcaaataccggcgactagagtaaccgctgctaccacgagcatggtggtcgggacggcaccaccatgctctttgctcttcaggtcaaccttttttagcgctatcgcaagaagcaccgggcagaccatcaccaccgttct

SEQ ID NO: 79521 - DNA, 328 bp, Zea mays
  Clone ID: LIB3088-033-Q1-K1-E10
gctccctcaaccaatgatgaaactcctctatctgtagaagacaagaatggaactgctggggtacaagatgctgctgaaaatccagaggcagaagaaactaacactgctgcagaggaaacacctgctgtagaggaagcaagtgagactaccgaggaggaagaggctgagaaacctgagatcaagatcgaaacagctccagcagattttcgtttcccaacaacaaaccaaacaaggcattgtttcacacgctatgttgaatatcacaggtgtgtggctgcaaaaggtgaggatgcacctgaatgtgataagttcgccaagtactatcgat

SEQ ID NO: 79522 - DNA, 314 bp, Zea mays
  Clone ID: LIB3088-033-Q1-K1-E11
cccacgcgtccgcccacgcgtccgttgactcgtggggccgggtgacaatggcttcgacgggttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgacgccggcaagtcggagtacttcgcgtcgtcgtcgacgctgttcgtgatcgagttcatcctgtttcactacgtggagatccggcggtggcaggacatcaagaacc

SEQ ID NO: 79523 - DNA, 273 bp, Zea mays
  Clone ID: LIB3088-033-Q1-K1-E12
ctcatcagcgaagcatgaagacattgtttttgagaacttgaggtccggcaatggggaggggtcctagtctcaggctcaggctgttggatgcaattgatcgttgcagtctctgtcacttgcttgctcatgatctttgggactctgagcatcacaaggcgttttcactgatgcttatctcggtaagaagattcgttagcctcttgcctgtgatctcaccatttactctaccctgggaatggaccggttgcattgtaacattacgtttacatgagt

SEQ ID NO: 79524 - DNA, 454 bp, Zea mays
  Clone ID: LIB3088-033-Q1-K1-E2
cccgtctaaaaaaggacaaggcagtggaaggtttacgtcaggacgtaactatgggtcattggaaggggaggcacctccaccaggctatgtctgtcgctcttgcggtgttccaggccatttcattcaacactgctcacaggaaaacaagatacctccacctggatacatttgctacagatgccgaattccagggcattttatccatcgttgcccaagcattggtgatcccaagtgcgacaacaataaaatgctttgttctcttgtcccagtagttacacctgtcaatggcattttggattcacttgtcccggcttcccccgttagtgctgttgatgacttgccagcaaagcttcactgcaagctatgtaaaaaagtgatgagagacgcagtattgacaagcaagtgctgttttgatagttttgtgatagatgtaagtggttttcattttttcata

SEQ ID NO: 79525 - DNA, 319 bp, Zea mays
  Clone ID: LIB3088-033-Q1-K1-E3
tcggtctgaggctgctgggtaccagaagcttcttgcccagaggctgaaggaacagagggaccggcgtagcgagagcttggccaagaggagatccaagctttctggcgacggcaaggcttatgctgtcacactcgcttaagaatattcagcgtttcgggatctatgttaggtctatctcgtaacagcaaaagtgtctagggatcttcgtaagctacatagttcacatcactcaagtgctactgctagtagaggatccacaactatttgctagcttggctttgagtcacacctgaccgatcaatgcatgtgtcactttcct

SEQ ID NO: 79526 - DNA, 442 bp, Zea mays
  Clone ID: LIB3088-033-Q1-K1-E4
tcgatcatttctctcctaaacatgtctttgctcgcggctattgttggcgggatattttcaagtatctagctgttccggtattgtcatatgcaccaagtcatggttatgatgacctctattttccaaggatttgccaattgaagcctcattcatcgcatcgcaaggagtcgatcagaggtgcggggtggcgtgacttcaattatctgccaacatcttcgtacgaagctgcaccgcatgaacaagtggacagttttctcctccctttgtcggatgcaattttcacatgtgaacaattcaagatccatgttctttcttcttagcagtgacctagtattcagtccagctttcaaattaagccagaagaacactttttgtttggttgacatttcatgcccacaaccacatgtattctgggtgtgctagcttttttgcaatcatgtgt

SEQ ID NO: 79527 - DNA, 331 bp, Zea mays
  Clone ID: LIB3088-033-Q1-K1-E5
tcgatcacccctaagtgcagcttttagacggttcgacagttggattttcattcagcacaaggggcatatgatcatgctcaatgatgtctaatatcagactacttgtcctgacacctgtattcaatgtcatcttcatgcagcgaacgttttgctcatgagattaggctatgatgtccttcatctgcgtatcattatgttacttgatctggttgtatcacttatctttgcatgttcacctttttttttaccatctttagaccttgttctctagtcatcttcagattttaagctatgaatattccttatttacagttgatttattattagaatc

SEQ ID NO: 79528 - DNA, 293 bp, Zea mays
  unsure at all n locations
  Clone ID: LIB3088-033-Q1-K1-E6
cagataaggcttttttgaaatgtaaccatctgtcaagggcaatgaggtaaggaaccctttccccacagtgatgtccgctactgctcatctcagatgatactacagtggcngcatcctgtgcccatcgcttcccaaggtgcttccgtttgccttcgcgacccttcgccgtcgccaaatgccatagctcaaaggagatcagtgttccttctttctacaaacatcatcgtactcgtcgtcgcaatcgcaatatgacaaatgaaagagcttccaagaaaagtttgctgagaaaagat

SEQ ID NO: 79529 - DNA, 289 bp, Zea mays
  Clone ID: LIB3088-033-Q1-K1-E8
acgatcatattgaccaatttggcttgaatatttgctaaaaaaatgtaattcacgtgtgatctctctcgggtctagcgttacagcagcaggcacaagacgcatactgcttaatggtcacaaacaaggcttacagtcacagtcctacgaacaaatttgaagctaatctgctcctggtacgcctaacaaatactctatccgtatctttttagttatagctggatagttcaatttttgcactattcatcgactactaaaacgaaacttacatagttagtgttacacccttgtt

SEQ ID NO: 79530 - DNA, 277 bp, Zea mays
  Clone ID: LIB3088-033-Q1-K1-E9
atgacagaaaggttcctgttaccgtcttttatgatactaagaggaaaccttcagcgcaggaatatgtaattggtggccatgtaaaccaggaagggtttcccaggaaggcatcaaggtatgagtttgatgataataggcctcagcaaaatattccagacagtcagcatttgccaaggatttataatacagattttgagaatttaatatatccagatagttcatgaaatacaagcaaaatggaaactaggatgacacatggtggaatgctagagtatgc

SEQ ID NO: 79531 - DNA, 369 bp, Zea mays
  Clone ID: LIB3088-033-Q1-K1-F1
tcggcaacaatttgctatcggcgtcaatgatttttcaagggttcttgagcgaatgccgcatggtgtcactgctcatgctgctcaaatgtctagcggagcaccaactgtctcaggccgacgtcaagctcctttggtgccattgcaggctgtccttgtagctgccgactgcaatcccaaatggttaacaaaacacataccaacactagcgtctacaaggcaggtaccggtattgtgcgtgaaggacaacaagggatgctcagtaaggttaggccatgtggtgaatgtcagaacagtccttgccattggagttaaggccaaagatagcgttctcaacaagaccattgttgagttcctgaaagacagttaact

SEQ ID NO: 79532 - DNA, 294 bp, Zea mays
  Clone ID: LIB3088-033-Q1-K1-F10
tcgtccgcccacgcgtccgaccactgccatgctctttgctgtccccgaacgttactcatgggctggacgttagattggagttgacggctacttcttcatggcctggggcaacgccactgttcctgctatggatattaccaactgggttgacaccaactaccactttattgtccctgaattgggcccaaacaccaagttctcctatgctcttcacacggtctgtaacgaatacaatgaggctaaggcgctaagtcttgataccttgccagctcttgttggaccagtcttttacct

SEQ ID NO: 79533 - DNA, 442 bp, Zea mays
  unsure at all n locations
  Clone ID: LIB3088-033-Q1-K1-F2
cggacgcgtggggcgatactagctagtccctaccaaagcatacttcctgaaacactcttgcaatccactgagttctgtttgttgagacgcatagagctagagtcgacaatgtcgctcgtgaggcgcagcaacgtgttcgaccccttctcgatggatctctgggaccccttcgacaccatgttccgctccatcgtcccgtcggcgacctccaccaactccgagactgccgtcttcgccagcgcccgcatcgactggaaggagacgcccgaggcgcacgtgttcaaggccgacctncccggcgtcaagaaggaagaggtcaaggtcgaagtcgaggacggcaacatgctggtcatcagcggccagcgcagcaaggagaaggaggacaaggacgacaagtggcaccgcgtctagcgcagcagcggccaattcgtcaggcgctttc

SEQ ID NO: 79534 - DNA, 209 bp, Zea mays
  Clone ID: LIB3088-033-Q1-K1-F3
tcggtgtgcccttcggcgagaaataaactcctatgctgggaggctgtcattgacatgtatgggcaatgcgttatattcattacagtgactggcattaacgtagattagcgaatcacggtaaatacattcattcttgccagtatcgatggctgtcactatatttcgttcttacaaaacaacatgcatctctagagatcttgttctttaaa

SEQ ID NO: 79535 - DNA, 391 bp, Zea mays
  Clone ID: LIB3088-033-Q1-K1-D3
cacgacatgctgaagaaatacataacctatgctaagctgaatgtgtctcccaaaatacatgatgccgatctagacacgattagccatgtttatgctgaactccgccgtgaatcctctgatggccaaggggttcctattgcagtgaggcatatggagtcaatcattcggatgtcggaggcacatgcaaggatgcatttgaagagctacgtgtctcatgaagatgttgacatggacatgcatgtctcgctcgactactgtatttcgactcaaaagttcggtgtgcacaaagcacttcaaaagaatttcccgaagtacatgacattcaagaatgactacaacgagctgatcctgctgcttctgcgcacactggtcaacgacaccatgcacttgg

SEQ ID NO: 79536 - DNA, 309 bp, Zea mays
  Clone ID: LIB3088-033-Q1-K1-F6
actcgttctaaaccatctcataggcacccattccgctttgtaaatctcaaggacattttggatgtgagcatgatttacatgtctctctgagtccagcacaccatgaactttcaaaacatccgggagaagaacatcatgaggtctgagctctgtatggagtttaagaaaatattctaggagatgtccatcttgttccatcttctaccccagtaagttgaactcacctatgttcggctctaacccactgcccatgggctcttatcatacaagattgacgatagtttaatatttttaagtctcatattgact

SEQ ID NO: 79537 - DNA, 79 bp, Zea mays
  Clone ID: LIB3088-033-Q1-K1-F7
ctcatctcgggtttcaaaaaaagattaaaaaaaaaaaaaaaaaaaaagaaaaaaagaaaaaataaaaaagggataaggg

SEQ ID NO: 79538 - DNA, 423 bp, Zea mays
  Clone ID: LIB3088-033-Q1-K1-A3
aagagtttggtattcctacacagtttcaacgattttggctgtgggccaagcgacaaaacgatacctaccgacctaacaggccattgtgtcctcaagatgaagcacatactgttgggcagctaaaggaactggtgaacaaggcccacaacgcagaactgaaactgttcttggaagttgaacttggactggaccttaaacctcttcctcttcccgacaagactagagaagatatatttcttttcttcaaactctatgaacctgaaaaggaacagctgcggtatgttggtaggctctttgtaaaggctttaggaagaccacaagacattctgctgaagttaaggatgttggcaggttttttacaggatgatgatattgaactttatgaggaaattaagttcgagcccaatgtgatgtgtgaataca

SEQ ID NO: 79539 - DNA, 294 bp, Zea mays
  Clone ID: LIB3088-033-Q1-K1-A7
cccacgcgtccggacatttgaaaacatacagaggtggctccgcgagctccgtgaccacgcggactccaacatcgtgatcatgatggtcggcaacaagtccgacctgaaccacctgaggtcggttccagaggaagatgggcaggcgttagcggagaaggaaggcctatccttcctcgagacatccgccctcgaagcccttaacgtcgagaaggcgtttcagaccgtcctctccgacatccatcagatcataagcaagaaggcgcttgcagcccaagaggcagcatgtagtggacc

SEQ ID NO: 79540 - DNA, 141 bp, Zea mays
  Clone ID: LIB3088-033-Q1-K1-B1
atcacatcatagtacatgcggtgctgaaacttctccaagtgctggcccaaggtcaaggcgatcaagaggcatcaggataggaacattgtggaacaccgcagtcatcacggacgttcaggaagcatgcgcctatgatggcta

SEQ ID NO: 79541 - DNA, 290 bp, Zea mays
  Clone ID: LIB3088-033-Q1-K1-B10
gtttggaggggatcagttcaccattctgttcaatgtctccgcttccatggcattggctgctttcattgcgctgggtcttaactcggtgatctctgcttactgcttcttcagctaggtttcatagagctaccgtcgtgcattgcatgatgtgaataatactacctgtatgctccttgcagcactgaaccttgattcatgtcaaattcctacacgatttctgtaaaatccctaaactccaaagcgggcctatattgttgcagcacattgagtcaaggttggcctttaaaatt

SEQ ID NO: 79542 - DNA, 256 bp, Zea mays
  Clone ID: LIB3088-033-Q1-K1-B11
cgcgagcgactcattcgatgggaactacaggggtcttggttattgtttggcgtgctttggtatcacaactgggtgggaaccagcagaagcggcttggaggatgtctaccgccttggaagtccctttgagcttattgagctactcacatagcttgtgcatgaagttgtgacatctgcaggctgaagctatatacagttaaaaaggcatcggtacgcatctgtatctgtaatcattatgtttatccactctatgtcta

SEQ ID NO: 79543 - DNA, 223 bp, Zea mays
  Clone ID: LIB3088-033-Q1-K1-B2
actgttcacacacattcaagatggttcaacgatatatttaatgtgatattctcgtccaaggcgtttgttgctggcttcggggcatattggctggacaacactattgacaggcatgaagcttaagtcaggagaaaccgatgctaccattggtgggacaaattccggtcgtacaggaccgatacaagaagcgaggagttatatttcctgccattcaatctgaata

SEQ ID NO: 79544 - DNA, 308 bp, Zea mays
  Clone ID: LIB3088-033-Q1-K1-B3
tcgtgactaccagtttgacgtcaagcagcgttctaggaaatgataatcttttttcatctggtgatctaacggcatgaaggaacctttgggtgctgtacacagttggttttgtagtgccaccaccatgcccttgagcagtatgctgatcactgtaagtagaagcgtaatggccggaacccggtgtgtcttgacgttgctccagacgtttttctttgcggtagaacgttaagggcatgtttggaaacataatttttttagtatcaagataataccgtgatggcaacgactgctatacaagcagtctttct

SEQ ID NO: 79545 - DNA, 371 bp, Zea mays
  Clone ID: LIB3088-033-Q1-K1-B4
cggacgcgtgggcggacgcgtgggtggttcaggaaccgctgagcagatcacagatccttgaagggtaggctgtgcaaagtggaatgtttggccatggatgatggacagtcgctaactcgctatgctcagccaagctgctgctgctgaaggctgaagctgaactcggcgatgtttctcagcgacactagaagataggttgttggtcatttaggactaactgtactgtacggtagcactgtaatgcaagggacttagtggatgggagcgtgccaattttggccgttgccagtactgtaaattagtccctctattttattttattttagtctctaaattgataaattcagaaactaaaatatgtcgcatttagc

SEQ ID NO: 79546 - DNA, 364 bp, Zea mays
  Clone ID: LIB3088-033-Q1-K1-B6
tttagattctatcgtcgccttcgcctgcttcttcagtttagcctccaagcaggggctccgggcggggtattgtggcctgggttgacgatagagagtcacttgcaccgggggagcggagatgaagccggttgtggggatcgtggtgtacaacaagatgcataagttggtggtggttgcacttgaccgtctttttcaacaaggtatacaaccggtacatgaagcgcaccttgaagttcatggctcacgacgatgacaacacctgcaacattggcaaccggtttacgctggatccttctaggaccttgtgcagacacaagcacttggttagtgctgaaattctgcccagagctaacgtgtacgtttc

SEQ ID NO: 79547 - DNA, 390 bp, Zea mays
  Clone ID: LIB3088-033-Q1-K1-B7
ctcgtagagagaaggaaaaatatccggataccctagctcccgatctcgatggcgaaccgtcgcgtcttcttggacatgaccgtcggcggcgccccggcgggccggatcgtgatggatctgtacgccaactaggtgcccaagaccgcggagaacttccgcgcgctgtgcacgggctagaagggcgtgggcaagtccgggaagccgttccactacaagggctccacctttcaccgtgtcatccccgagttcatgtgccatgacggcgacttcacccgcggcaacggcaccggcggcgagttcatctacggcgagaagttccccgacgagaagttcgtgcgcaagcacaccgtccccggtgtgctctccatggccaacgcctggcccaacacc

SEQ ID NO: 79548 - DNA, 264 bp, Zea mays
  Clone ID: LIB3088-033-Q1-K1-B9
tcggccgacccaaataacacagatccatgaagtcaaagaaaagaaagggaaaagaaagtttgggaaagttcgtgcatactattgttgcagacacaatggttactggagtcagaagttgacatgtcatgttgtaacaggatcatcgtcttctgttcagttaggccttatttttgctagtcctcgaactaatggaaaactattccatctttaaggccccatcaaattgtaatgttttactatgaaaaggttggctcacccttgtgt

SEQ ID NO: 79549 - DNA, 362 bp, Zea mays
  Clone ID: LIB3088-033-Q1-K1-C11
tgctttcgaactctgaagctgacgtcccttagctttggagacttgaaccacttgagcagtgcaacgatgagtggtgtcacttgctgcctacgcttcccaggacagcttaactctgacctgcgcaagcttgcagtcaacctgatcccgttccctcggctccacttcttcatggtcggctttgcgccactcacctcgcgtggctcgcagcagtaccgtgcactcactgtccctgagctaacccagcatatgtgggatgccaagaacatgatgtgtgctgctgacccacgccatggtcgttattctacagccctttccatgttccgttgcaagatgaacactaaagaggttgatgagcaaatgat

SEQ ID NO: 79550 - DNA, 228 bp, Zea mays
  Clone ID: LIB3088-033-Q1-K1-C12
gaagacgaagatgaagacgaggcctctcttcgggtatattgaacgaaggagaaggcgggtgcgcgcgctatgctgaggctgctaatctagcacccgtctagacgtttcccttttctctggtggattacggactggatcggaccaaagatcgatccagctactagttctaataatatagtctgtacttgagaaaatgaataattgtaatttattgtcttcttgggacca

SEQ ID NO: 79551 - DNA, 78 bp, Zea mays
  Clone ID: LIB3088-033-Q1-K1-C2
aaaaaaaaaaaatacacacaaatataggatttaaaaaattccaaacatcaaaacaaacaagggccaaaacgcaaaggg

SEQ ID NO: 79552 - DNA, 415 bp, Zea mays
  Clone ID: LIB3088-033-Q1-K1-C3
gcatctgcagcgtcatatgctctacgacttccatgtttgttacgaagtagcttcatttgttttcttggaacgccctaagcgacaccagaaaagctacctgacgttataaattgtttgtttcgtgttcaggacgagctatagatcctgtattcttttgaaatctgcacgatattggatgtctgtctacggagagcgcacgtgcaaaacttgtatgttgtactcacggatgaagctgaacctgtgattttggcgatgggtagagattggccatcgcgtctgttactaaatttccacgttgcgatgcaatatgagctgtaatactgttctcgcactattatttaccgtttgtgctgcatatgtttgatttaaaccttcaaaaaacaatcactaatggcctgaatgagcactgtctttg

SEQ ID NO: 79553 - DNA, 187 bp, Zea mays
  Clone ID: LIB3088-033-Q1-K1-C4
gcctaaggaataacgtcatgatttttggagaccacaagggccataaattttggcaggtaattttaccccgggctattaagggggggtcatactcaagggaaagaacaacgaaacattaacaatgaacacgacagtgcaacgtgcatgggcatagcagtaaccaactttggcgctcttttggatttta

SEQ ID NO: 79554 - DNA, 148 bp, Zea mays
  Clone ID: LIB3088-033-Q1-K1-C5
ttatttatttttattaatgttttaatgttttgatattattcctatttatggagttttgggtttttttctaggggctaaggaataacttatttattatttaataacttaaattatctaaaataataagtaataaatatatactattact

SEQ ID NO: 79555 - DNA, 238 bp, Zea mays
  Clone ID: LIB3088-033-Q1-K1-C7
cccacgcgtccgcccacgcgttcggatttcagtgttctaactttggtggttctgccccgctagtgtagatattgtgctactgtacgtagtgtctcccttgctctattaagctttctgatcatgagacatccagtttatctataaacaaaattgttatgaacatgctcgatttctactatgatgtaatttgccatctttcttggcacaacgagcatcatataatatccagtgttcctgt

SEQ ID NO: 79556 - DNA, 430 bp, Zea mays
  Clone ID: LIB3088-033-Q1-K1-A2
aagagtttggtattcctacacagtttgaacgattttggctgtgggccaagcgacaaaacgatacctaccgacgtaacaggccattgtgtcctcaagatgaagcacatactgttgggcagctaaaggaactggtgaacaaggcccacaacgcagaactgaaactgttcttggaagttgaacttggactggaccttaaacctctttctcttccgacaagactagagaagatatatttcttttcttcaaactctatgaacctgaaaaggaacagctgcggtatgttggtaggctctttgtaaaagcttcaggaagaccacaggacattctgctgaagttaaggatgttggcaggtttttcacaagatgatgattttgaactttatgaggaaattaagttcgagcccaatgtgatgtgtgaatacattgacaac

SEQ ID NO: 79557 - DNA, 208 bp, Zea mays
  Clone ID: LIB3088-033-Q1-K1-C8
aaaaaaaaaaaaaaaaaaaaaaaaaaaatttaaaaaaaaaaaaaaaaaaaaaaaaaaaaagaaaaaaaaaaaaaggaaaaaagaaaaaaaaaaaaaaaaaaaaaaaaaaaaaaaaaaaaaacaaaaaaaaagactaaaaacatcaaaaacaacaataaccagaagaaagcaacgaagaaagacctaaagaagagaaacaacaagataa

SEQ ID NO: 79558 - DNA, 55 bp, Zea mays
  Clone ID: LIB3088-033-Q1-K1-C9
attcccgtctgcacgcactcatcccgcatttagctaaaaaatactattatagctt

SEQ ID NO: 79559 - DNA, 275 bp, Zea mays
  Clone ID: LIB3088-033-Q1-K1-D2
gtcgacccactcgtgcgaaatgttacaaagatacagtattggtaacatttatgttgcctcttgttggtagattagggagtcagttccattttttttggcatgagcttatttgaacaacctcgttatcaccccgtgcaaacaaaaaagaatctagttaaacgccaattttgcctactagttaatggtcggaaataccagtgtagaatcagaaatcggttacacactacagaataatgtatctgatctactctgggtaagcattaatctttaacaag

SEQ ID NO: 79560 - DNA, 368 bp, Zea mays
  Clone ID: LIB3088-047-Q1-K1-B11
cccacgcgtccgcccacgcgtccggcagatgggtttgagtgatcaggacattgtggcccgctctggtggccacaccttgggaaggtgccacaaagagcggtctggttttgagggggcctggactacgaaccctttggtctttgacaactcttacttcaaggaacttctgagtggcgacaaggagggccttcttcagctcccaagtgacaaagccctgctgagcgaccctgtcttccgccctcttgtggagaaatatgctgcagatgagaaggcattctttgatgactacaaagaggcccacctcaagctctccgaactggggtatgctgatgcttaaatggtccatatcctggagcgggacacaaact

SEQ ID NO: 79561 - DNA, 405 bp, Zea mays
  Clone ID: LIB3088-047-Q1-K1-B12
acgctcacgcatgaacctacgcttgattcatctcctccttccgctcgaacactaatggaggaagctttgcttaaaacatatgctgttctgctcaaaaaaaaaaaaaaaataaaaaaaaaaaatgaactacaaacccttataaaaaaaaaaaagggggcgcccctttaaaaaacaaaattaacaccccggcattaaaaagggtgcccctttttaaagggccccaaaattaaaatcccttgccgcgaattttaaaaactttttaatgggaaaaacaatgtaattcccaaactaatatttttaaaaaaaaatcccttttaaaccatttggttaaaaaacaaaaagccctaaaaaaaacccctttcaaaaaattggcaattttaaataaaaaagggaaccccccttttt

SEQ ID NO: 79562 - DNA, 428 bp, Zea mays
  Clone ID: LIB3088-047-Q1-K1-B2
gcgtcttcgacaaggaccagaacggtttcatctcggctgccgagctccgccatgtcatgagcaaccttggcgagaagctgaccgacgaggaggtcgacgagatgatccgtgaggccgacgtcgacggcgacggccagatcaactacgaggagttcgtcaaggttatgatggccaagtgaggagcggtccccgtgaaataagtatctatggattgaagcgaattatcaggcacacaagctgtactttgtcatgtccctttgagtacgcatcagtgtcatgcaggtggtaatgtcttgtagtggtccgtttaggcggtgtagtcatgggaacgcgacatcagatacctggtttcttttgattgtgatgttatcttgcattattgcacctgtaggatttgttgaagctcatattttccaggggtttggatc

SEQ ID NO: 79563 - DNA, 390 bp, Zea mays
  Clone ID: LIB3088-047-Q1-K1-B3
aggcagacaagatgtacaagttctatgtccactcaatcactggtctacgattgctgtcaaagcaagatgtactactctatatcaacgaggcaaaagtctctgggtgcgacaccaatggacaatgtgacacaacttctgaagataacatactctcaaaagtggactttcggccaagtggattgcctgaaggttgggtgaaagaactagtgtacagaaaaaccaaggaagggttgatcaagagagatccgtactacacggatcctgctagttcctacacattccgcacgctgaaatctgcattatccttcctaacttccaaatggtttgtgcatgataatgtgagtattgccattctgtctcagtgtcagtgtaatactctattaccttaca

SEQ ID NO: 79564 - DNA, 303 bp, Zea mays
  Clone ID: LIB3088-047-Q1-K1-B5
cccacgcgtccggcggatggaggcacactctggccctctccgagaagaaaaatgtcttctcctgggggaggggcactagcggacagctcggcaacggtgaaatagtcgacaggtggttcttaccccgtgcgcgagctctcagtgtctatgtcttcccctgccccttgtaggaacacgcctgtgctgatctgatctgatctgacaactaacgtctcaccatcctgaaggaacacacctgtcctgtccaatgccctgacctcaaatggtcctgcctgcagaaacctaaagtattccacggaagcc

SEQ ID NO: 79565 - DNA, 370 bp, Zea mays
  Clone ID: LIB3088-047-Q1-K1-B6
ccaagaagacagccctgatcaaggcgattgaggatgctgatgtgaagaccaagtgggagaacaggtcatggggcaagaagctgattgtccataataggagagcatcgctcaatgactttgataggttcaaagtcatgctggcgaagattaagaggggcggtgctatcaggcaagagctcgccaagctgaagaaggcgtccacggcttaaggagtctctttccgtgaatgtcatgttagagtttttggttatgagttggatcagcaattcgattgagcgttgtcaaagccagaattaccaatatgttccctgtaaacccatttcaaactttatcaagcacgggcgtgctcaagatacttttgccatgaatg

SEQ ID NO: 79566 - DNA, 70 bp, Zea mays
  Clone ID: LIB3088-047-Q1-K1-B7
tctgtatgaaataattgttcgaattaaattttgaagcaaaagaaaaaaaaaaaaagggaaggcatggtct

SEQ ID NO: 79567 - DNA, 359 bp, Zea mays
  Clone ID: LIB3088-047-Q1-K1-B9
gcggacccacgcgtccggctgcgaggcctcccctatgatcgcaactacattgacgtctgcaagttctttgggggggtggacatagtggactggctcctggttaacaagaacgggcgcttcaccggcgaggcttttgtagtcttcccaacagccatgcaggcagagtttgcgctgcaccgcgacaggcagaacatggggcggaggtatgtcgaggtgttcaagtgcaagaagcacgagtactactgtgcaatagccaatgaggtgaaccagggcggttattttgagccggagtaccgtcgttccccgccttctccgaggcctaggaagccgtctgaaaataacggcagcatggagtacac

SEQ ID NO: 79568 - DNA, 301 bp, Zea mays
  Clone ID: LIB3088-047-Q1-K1-C1
gttcgacgggattggacactgttgtccacgaaggaggtaggaccatcgagcttgcggctggtgggctgctcttcacccgagactgctccggcgagctgaaagtgtggaggggggcgcccaaggactaggaggcagtagctgatgtgcatcaaatagtgtagctgtagcctcattgaagaataatagccactgacgtgctccatcattgtattcggttccatgtaaattatggctgctccccctgatgatgtaacacatacggccaattttgtgaggatgcaacccctggtatcatgttcca

SEQ ID NO: 79569 - DNA, 274 bp, Zea mays
  unsure at all n locations
  Clone ID: LIB3088-047-Q1-K1-C2
ccgtggcccgcggtttggttctccggtcctgtgggtcgcatgtctagcgggggaggtagtgacctctttccgttgtcgctgcctcacgggccatggcaacgcacgctacgtgtttgtgggaaatgtcgcactgcagagagttgactgaaagtgtttctgcgtcgtctcgagacgcatttgttgagacttcaaacttcgtgtcgcagactntaaatttcgtgtttcggacttaaaactctaaacatcgtgtttcagactttaaacttaatgtttc

SEQ ID NO: 79570 - DNA, 269 bp, Zea mays
  unsure at all n locations
  Clone ID: LIB3088-047-Q1-K1-C3
tttacactcccttcacaacatgaagtagctgtcagatttttaactggccacttcctnactnccttactaacacatgttatccaacaatgattttattaccaaatatcttactgctaaaagtttactctataccatatactacctcttcaagacgaatttgttgaaactaaaacctaagtactaaaaactataaacttaaatgcatgaaataaaaaaactaaacactcatttaaaaacattaaccactaactttcttaaaaaaataataa

SEQ ID NO: 79571 - DNA, 336 bp, Zea mays
  unsure at all n locations
  Clone ID: LIB3088-047-Q1-K1-C4
cccacgcgtccgaaaaaaaaaaaaaaaaattaaatttaaaaaaaaaaaagggcgggccgcgcgcgagctancgcaatcctgcagattataggcctgatatcattcatcaggctctactagcaatatttgatagccctctaactaaggctggaaggttacaggctgtttatgtgagaactgaaaagggcgtattgtttgaaatcaaacctcatgtccgcatgccaagaacctttaaacgtttctggggtttaatgtcacaattgttgcaaaaactgagcattacggcagttggaaagcgtgagaagcttctcaacgttggtaaaaatcctgtcactc

SEQ ID NO: 79572 - DNA, 418 bp, Zea mays
  Clone ID: LIB3088-047-Q1-K1-C5
gcggaaggactcacgacccatcatgccttgtctcatcatgtaggcatacagaagattgacgcgtgaagggtagatcccacggcgctctgttcctacgctcttccgctagaactgacacacatcatgcaggagtcgcgacatatgtgggacaatcgttttccacgtaactgcggacctcctcatacgtaccatgggaattgaaaacctgtgtactgtaaagatagccccaccgtttgacttcatactagccgctgatgcgctgaataacaagtggctgctcctgtcacgagctagatgtcttgaaatgggtttggcgaatgatttatcaagaacaatgtttggattacagggtcgggcatgcggatgggacctgcgagacgaggatctattccaaacgcagttttgtaagattttactt

SEQ ID NO: 79573 - DNA, 398 bp, Zea mays
  Clone ID: LIB3088-047-Q1-K1-C6
gcagtagcacggcacatttgaacacagtgtttagctgcatctcagataccatcgttcgacagattgtgttcagtcgctacgcccgtccactgtgctctgctgctcccatctgtatccgttcactccatggtacttgcactccacatctacgaatatacgtacgccatctttctttgtcttagctttcgcagcgtgggttggctcatacaaccaagatttacactggatggcttcttaaatactatctcgtgtacaatggaccacacatgtcgaaactacacttgctgtctaaagcccttgttgatttctaccggaagcgatgtagtacactgtacacgctgtaccactgatgatacgaaatgcgagtaggattactcaattctttggcatcttgtggc

SEQ ID NO: 79574 - DNA, 356 bp, Zea mays
  Clone ID: LIB3088-047-Q1-K1-C9
cggacgcatgggttgcaagtgaccctgtgttcaaccagatggctgaacagcttgagaaaagtgctcatggtgctggagaacacggtattcctgcattggatcctcaacagtatatggaaacaatgcaacacgtcatgcaaaaccctcagtttgtgtcaatggcacagcgtcttgggaatgcccttatgcatgatcctgctatgtccagtatgcttgagaacttgaccagtccagctcataaggagcagcttgaggagaggatggcccgtatcaacgaagatccatccttgaagccaattcttgatgagatagagaatgggggtccatctgcaatggtgaagcattggaatgaccct

SEQ ID NO: 79575 - DNA, 410 bp, Zea mays
  Clone ID: LIB3088-047-Q1-K1-D10
gccccccgtaccaaagtgttcattagtttcaccggatgggcgcactcaccagggctggttcttttaccctgacggcaatggcctataggttactagcgctggtgcagggaatgagaagtgaacagagaccatgatttgcagtctacttctgttttatcgtgcaatacctcagcaaaccctgcctacatgatgcgatcgaaaccggagacgttcctgggtcaagcttcgttccgtaaaataaataaatccgaagcacttcaaagctctacatactctcccttgcttgtttgatacaagggcttgcgttcttgctgcatctcatccgagatgattgtaatcccaacaatgtgtagttaataaaaattgtcgttttccctgaaaatgttttaacctgtaaacatcgctctgta

SEQ ID NO: 79576 - DNA, 357 bp, Zea mays
  Clone ID: LIB3088-047-Q1-K1-B1
gcaaaatcccaattgtaaacaggaaaaggtgttttatttccaaacattacaactgttagggaaggggtcatggaacctggagttatgatcctacttttgtccctaaccaagggttacgtctagtcttctctcctgggtgcttgatatctcatgccatatcaatgtatcagtacttactattgtttgtcgatataaggaattgctgacgtgcacataaaaatgttattctatatggactcagacacacacgttgttaagacaggttcatttggtaataactaatcattatcttccatgacttaccatttatgttactcatttgccatataagcccactctaaactaagggacagttaa

SEQ ID NO: 79577 - DNA, 423 bp, Zea mays
  Clone ID: LIB3088-046-Q1-K1-H1
cctgtctctgcggcggctgcgggctccttcctgcagcgctgctgcctgtgccacaaagagcttgccgagggcatggacatctacatgtacaaaggcgaccgggcgttctgcagcgaggagtgccggtgccggcagatcttcatggacgaggacgccatcagcagctgctgcggcaacggcgcgggcgccgccgccgccaccgtgcgcggcaggcggcgagtcaagacaagacaaggatgggaacgtgaatgggagacgtagcttaggtggtgcaccagatgaccagatcttcttcatggaaacttggatggggagacggagacaagacaaggatgaagatgatgaacacagtgtggaaatgtctgccagctcatcccccgtgggggtcccgtcgcatgcgcagcacagtaatagtacgtgcgt

SEQ ID NO: 79578 - DNA, 442 bp, Zea mays
  unsure at all n locations
  Clone ID: LIB3088-046-Q1-K1-H10
cccacgcgtccgagctcagcatcacactcgtcggccacagccttggcgcgtcgctggccgggctcgccgccgacgagctcagcgcctgcctggctgctgaaacagacggcaccgcggaccaccagccgccgccgatcgcggtggtctccttcggaggccccaagaccggaaaccgcgcgttcgcagagcggctgcagcgcgagcgcggtgtgaacgtcttgcgggtggtgaacgcgggcgacgtggtgacgcgcgtgccggcgccgatcgcgcgggaagggtatgtgcacgcgggtggtgctgagcttagactgcacaacagcgactcgccgtgcctgcgtcccgacgcgggcccagcgtgctgccacgacctggaggcgtacctacaccttctggatgggttcgccggctccgggcggccgttccgncccgacgcgagccg

SEQ ID NO: 79579 - DNA, 444 bp, Zea mays
  Clone ID: LIB3088-046-Q1-K1-H12
gagtgcccgaagatgaagagtccggcctcctcccacgcccgtccgcagccgggcgacgggcgtgctcccgcgggccccgcttcccgcctccaccggcagcctgagcgacggtggacggccccctagggctttcgctggaggacgcggagggccacgcccgtcgcttcttcatgtggggattcgcgtgcctccccttactatgggccatcaactgctgctacttctggcccgtcctccgctcgtcggtcgcctgctcgcccgtcggctatcgccccatccgcccctatgttgtgcggtcggcaattggcttcaccatcttctgcgttgttctggtcacctgggccacgaccttcgtcgtcagaagcgagcggttatttgcgccagtgtggaatgatcttgtgatgtacaatgtcgccgacaagcttggcatctctggattcatgg

SEQ ID NO: 79580 - DNA, 380 bp, Zea mays
  Clone ID: LIB3088-046-Q1-K1-H2
cccacgcgtccgcccacgcgtccgcccacgcgtccgcccacgcgtccgcatcacgtcccgcgagatccagacctccgtgcgcctagtcctccccggagagctcgccaagcacgccgtctccgagggaaccaaggccgtcaccaagttcaccagcaactgagcgcgctgcgggatccgcggatctgttagaagggttctttgctgtgtcctttccccagtcccccaccctacccgcctagtagctagcttgcctgctctataaatccggcgcgccggattgtaatggtcctcttagatttgatgtccctgttgtggaatatagttgtatctctccgcttgctattattctcattctttaggaacttggaaatctggtaatt

SEQ ID NO: 79581 - DNA, 426 bp, Zea mays
  Clone ID: LIB3088-046-Q1-K1-H3
ctcctagataaacttgtccgtgaaccaattgatggaaatgcttggcatgcagatcacatgatacctggttataaaggaggaggggaatgtaaactcgagaacatgagaacactgtgtgtggcttgtcattatgaggtcaccagaactcagcacaaggaactaaaagaaataagaaagaaggctaaagagcacttgaaaaacgccttgaataaacaaaaggataaaccaagtgaagcaacagaagaactagatgacgaatcgttgctgatagctgtcccgggtagtgcctactccttaggatttcctggcaacggatctgatgaaaaggctgctgaatagggcatgtttcatttaccttgattattgttcaaaaagggcgctggtattttttagctcgcgtcctttttttggacatgttaaatgcta

SEQ ID NO: 79582 - DNA, 249 bp, Zea mays
  Clone ID: LIB3088-046-Q1-K1-H5
gtcccctgcctccaagaaggcactgaaggcctccgcatgagatgggttgctgtaggtctgaggctctgattgtggttggtgtcagataggtactgtacaaactaagtgtgtgcccaaagtgtctcaagcggagtgttatgtgcttagcaagttctatctatcatagtgttatacgctaacaaacacttgaaaaacgccttgaataaagcagaaagataaaccaagtgaagcaacagaacaactaaatga

SEQ ID NO: 79583 - DNA, 362 bp, Zea mays
  Clone ID: LIB3088-046-Q1-K1-H7
gagaaaaaaaagaaacacaaatgataaaaaatgaaggaaatacaactaaaatgggtacctggggatcgagcgcgagtctgaaagcctactcgttaacttgacaacactgtgagtggttagtcatcatgacgtcaccagaactctgcacaaggagctaaaagatattaccgagcaggctaatgatcaccttgatgaacgccctgcttaatcataaggatcaacctagtgatgtcaccagatgacgtacatgacgaatacgcgctgatagctgtccctggtagtgcctactccttacgaattcctgacaacggatctgatttaaaggctgctatataaggcatgattcatttaccttgattatt

SEQ ID NO: 79584 - DNA, 331 bp, Zea mays
  Clone ID: LIB3088-046-Q1-K1-H8
cgagaagcacccagtcaacctgatcctgctcggcctcttcaccggtgccatcgagctatggtgagggcatgacatgtgccttcaccagtggcaaggtcattctggactctgcaattgtgacaacagtggtcctgctcagccttaccgcatacactttctgggccgcgaataggggcaaagacttcagctttctgggtcctttcctgttcgccgacctcatagtgctgcttgtgttcccactcatccagattctgttaccactgcgcatgctgtcccagatgatctacggaggtctggcgtcgatcatcttcagcggacacatcgtctacga

SEQ ID NO: 79585 - DNA, 250 bp, Zea mays
  Clone ID: LIB3088-046-Q1-K1-H9
atcgcgccagaccacacgccgacagcgacttctgcaccagcagctgggagcgcgcgaaacgagtcggaggacaggcagaagccgaaggcggatgataactacagcggcaactggctgaacccctgggcggagcccttcaggccttctatgacgctgtaccgatggctggtgaccatggaggcgacggctgagcatgatgatgaggactctttgcgagagtggtggcacctggtgtgcgtctgcacgaact

SEQ ID NO: 79586 - DNA, 367 bp, Zea mays
  unsure at all n locations
  Clone ID: LIB3088-047-Q1-K1-A1
cccgggaatcgcagctgtgtacgacaaattgctagtggctgatgatttgcaatccttcggggagcaactgangaagaactatgaggagacaaaagagctactccttcaggttgctggtcacaaggacgtccttgaaggtgatccttatctgaagcagcgtctgcggctgcgtgagtcctacatcaccactctgaacgtgtgccaggcctacaccctgaagcggatacgcgacccgagcttccaggtgagcccgcagccgcccctgtccaaggagttcaccgacgagagtcagccggcggagctggtgcagctgaaccagcagagcgagtacgctccaggcctggaggacaccctcatcctgaccatg

SEQ ID NO: 79587 - DNA, 68 bp, Zea mays
  unsure at all n locations
  Clone ID: LIB3088-047-Q1-K1-A12
gaaaaccgggccgacgcacgcgtncgaccaacctttccgcactctctctgcgtcaccgaccgacctga

SEQ ID NO: 79588 - DNA, 373 bp, Zea mays
  Clone ID: LIB3088-047-Q1-K1-A2
cccacgcgtccgacaacttcaggatcaattataggctgagaagcaagaaaaaatggactgcgtgatgaagcggaaaccattgatagtatgaagaggttgatggaagaaaataacaaccttcttcgtcaactataaagcttcaattgaagaaaagtgcctccatcttaagtttggttgactactataggacatgcagccttgtggtagctatagtagtagtagatatttatagttgctctagatttgaagttataggattatttttaattatgtttaatgtttaataatttgagttgaagttataagatttgctttgaattttaagttaaaggatttgagatatatggtttggagttatatgattatttgatgg

SEQ ID NO: 79589 - DNA, 394 bp, Zea mays
  Clone ID: LIB3088-047-Q1-K1-A3
cggacgcgtgggcaagcgtctcgtctgggctaggcctcacaggagccacctgcgcctccgagcaacatcctcttcatccagaatctgccagaccagaccacgagcatgatgctccagatcctgttccagcagtaccctggcttccgggaagtacggatgatcgaagctaaaccaggcatcgcttttgtggagttcgaggacgacggccagtccatggtcgcgatgcaggctctccaaggcttcaagatcaccccggagaaccccatggctatatcctatgccaaaaaatgagaaccctaggggactccctgtaccggctttgttattgacacaatccaatgtggattatgacttaaattagtttaagttgcactctaatccacctcaataatag

SEQ ID NO: 79590 - DNA, 238 bp, Zea mays
  unsure at all n locations
  Clone ID: LIB3088-047-Q1-K1-A4
cccacgcgtncggttggtgagatggatctgttggatcggaatattaagacggagacgggggagacgcgcaatgaacaggagcgtaaggaggaggtggaagcggaggcggtggagaggaagacccatgagccgccgcagcaaggccagggcctcagcctctcactcgccaacggcagtggcaggtctggaatgttgccgatgtcaaacatgtcagcttatccttcacagcttacaattt

SEQ ID NO: 79591 - DNA, 263 bp, Zea mays
  Clone ID: LIB3088-047-Q1-K1-A5
gaagaagataggtgttcaacgtgggatccaatgttgccttcttgttgtcactggactgcgttctgcaaggtttgcggttagatcaggatgtaatggatgctccgtttacttcaaaacttgcttaattttatgtcttgtaataatattcgaaatgatgttaaattttaacatttgttgaagtgtttagggcatcatgatagatgatacatctactatctatcattgtaacatgcttgttgtaatgtgtatttcatgcctcatca

SEQ ID NO: 79592 - DNA, 247 bp, Zea mays
  Clone ID: LIB3088-047-Q1-K1-A7
attcgaggcacgacccacgcgtgcgatcacacatccgtgctcaaactttttaaatttatgagccatacaagaatctatgagcctcagttaacaccaatgtgatggtgagacaaaaatcaaagtaattcatggtgcatgccacaaggactctctcataggtgatcctgatattactcaccttgtggagaaacgctacctctacaagaccactctatacattttccattcctacaccctttaaatcata

SEQ ID NO: 79593 - DNA, 377 bp, Zea mays
  Clone ID: LIB3088-047-Q1-K1-A9
aagaggaacaacaactggctcccacctccatgggcacttgctgcaatggctatccggggattcaacgagtttatgacattactgaggaatccgctttacctgtttgccatatttgtgatttatcttgttggaaaagccctttgggtgcaatcagaaattggcagggaattccaacatggatttcttcctgccatcctttcactgtcgacgaaatttgttcccactgtaatgaacatcctgaagagattagctgacgcgggtcaagaacctgcagcagcccccgagaggcaaagagagatggagctccaaccaaaatccaccaggaacggttccttatacaagaatgtgacatcgggagggtcatctatcgtaaccac

SEQ ID NO: 79594 - DNA, 431 bp, Zea mays
  Clone ID: LIB3088-046-Q1-K1-G9
ccgtgttcctactgtggatgtctcggttgttgacctcaccgtcagaatcgagaaggggggcgcctatgaggatatcaagaaagctattaaggctgcttccgagggtccactcaagggtatcatgggttatgtggaagaggatctggtttctaccgacttccttggtgacagcaggtcgagcatcttcgacgccaaggccgggatcgctctgaacgaccacttcgtcaagctcgtctcgtggtacgacaacgagtggggctacagcaaccgcgtcgtcgacctgatccgccacatgttcaagacccagtaggggtttttcccccctgcttctcatggatggttgctgcttgtgtatgccgagaataaatgtggatggcgcgtgcctctgggtcgccaggttcatgctgagtctggacatgttttgcactttt

SEQ ID NO: 79595 - DNA, 410 bp, Zea mays
  Clone ID: LIB3088-046-Q1-K1-F12
cccacgcgtccgacaacctcttgaagctcgcggactttggactggcgagggcgttcggcgtccctgtccggacgttcactcatgaggtggtgacgctttggtatagagcgcctgaaatccttctcggtgcaaggcattattccacccctgttgatgtgtggtcagttggttgcattttcgctgaaatggtgaaccagaaggcgctttttcctggcgactctgagatcgatgagctgtttaagatcttcagaattttgggcactccaactaaagaaacatggccaggcgttacttcgttgcccgattacaagtcaactttcccaaagtggccacctgtggatcttgcaacggtggtcccgacactcgaaccggcgggaatcgatctcctatctaagatgctgcgtctagat

SEQ ID NO: 79596 - DNA, 412 bp, Zea mays
  unsure at all n locations
  Clone ID: LIB3088-046-Q1-K1-F2
cagagaaaagcgccacatgaagaaacaggtaaacgcttatcccaacctgatacaatatatgagcnctatgcgtctctaaagaccagcgcagaagccaagaaagcaagttcgaccagaaccctctggcgtccataagttaacattcatggcactcaaggccaagaagctgttcttaccatgcgacgatactatgcacgcctgcaagaaggactgctgggtcgtcatcggctgcaaggtgtatgatgtgaccaagttcttggaagaccaccctgtatgagaggatgtgcttatccatgcatcagcctctggggatgccacggaagcattctaagaggtgagacacagcactttaaccgtcagcatgatggacagctacttgattggaagccataaagactatgttcgtccaatg

SEQ ID NO: 79597 - DNA, 355 bp, Zea mays
  Clone ID: LIB3088-046-Q1-K1-F4
cccacgcgtccgccaagacttacccctccctcggtgcctgatacctctatggtccgcaggcggctctaaagacaaggcagtcgtcaagaaagggagtttgaccaagagcctgtggtgtccgtcggctgccatccatggcaggggaggccaagaagctcttcttcgcatccgaggttactctccacgcctacaggaaggactgctgggtcgtcatcggcggcaaggtgtatgatgtgaccaagttcttggaggaccaccctgtgggagaggatgtgcttctccatgcatcagcctctggggatgccaacgaagcattcgaagaggttggacacaacactttagcccgcagcatgat

SEQ ID NO: 79598 - DNA, 161 bp, Zea mays
  Clone ID: LIB3088-046-Q1-K1-F5
gcgcggacgcgtgggcggacgcgtgggaaaaaattaaaaacaaataaatgaaaaagggatagagtgaatataaagaaaaaataaataaaattaaatgaaaagaagatatacaacataaaagactggaaaaacacatgaagttacaaaacttaataaaaata

SEQ ID NO: 79599 - DNA, 335 bp, Zea mays
  Clone ID: LIB3088-046-Q1-K1-F6
cccacgcgtccgccaagatttacccctccctcggtgcctgatacctgtatggtgcgcatgcgtctctaaagacaaggcagtcgtcaagaaagggagtttgaccaagagcctgtggtgtccgtcggctgccattcatggcaggggaggccaagaagctcttcttcgcatccgaggttactctccacgccttcaggaaggactgctgggtcgtcatcggcggcaaggtgtatgatgtgaccaagttcttggaggaccaccctgggggagaggatgtgcttctccatgcatcagcctctggggatgccacggaagcattcgaagaggtgggacacagc

SEQ ID NO: 79600 - DNA, 76 bp, Zea mays
  Clone ID: LIB3088-046-Q1-K1-F7
tcggacgcgtgcgaaaaaaaaaaatccaaacttacatacacaataacatacaacgtaataacgaaaaatataaaga

SEQ ID NO: 79601 - DNA, 131 bp, Zea mays
  Clone ID: LIB3088-046-Q1-K1-F8
acgcccactcgtccgcccacacgttcgaaaaattcaaaaaacacaaaaatatagaggtaaacatacaaatatacaaaatccatttagccataataaatatatgttagtcctataaccctaagtgtccaact

SEQ ID NO: 79602 - DNA, 176 bp, Zea mays
  Clone ID: LIB3088-046-Q1-K1-F9
cccacgcgtccgctcgttggcgccactggctggtggttctgcctctggtctggtgtgtttgtgtgtggtcacacttgccagctagcagaggcgcctgcttgtacctagattactgtttccattgtcgtcgtcatcggctaacattgtcataatgtcagtttgggtaatgttagatt

SEQ ID NO: 79603 - DNA, 400 bp, Zea mays
  Clone ID: LIB3088-046-Q1-K1-G1
cggacgcgtgggtacggatccgccctcaacatccgcaaggatctcgatgcccaaatcctgtccaggtgccaaaggccccctggtgctttgccgtcatctctgcttggatacgaggcactgacaggttccttggatgattttggatttgaagattatccttaacatgcctcatgattctgacagtttccgtcaacctgacatgcaccatggaatggaggttcgccttggtttgtccaagggacctatctgtcctagcttcaattgaggcagtaatgtaattctgctgcaagttcacctctcagtccagtacttcagtcaatagaccatattaagatggtgaaatatgaaaactggtagcttgcatctgttcaatgttatgttttaatcaacgctgaattta

SEQ ID NO: 79604 - DNA, 284 bp, Zea mays
  Clone ID: LIB3088-046-Q1-K1-G10
gtccaacttctggtgctcctccagctccaccgactgctccacagcctgcgttgtcctatggtcccccatcagaggggaaccactgattctgttccttaggcatgacttgggaggccatatgaagtatgtgcagaaaggctgttcctttggaggttgatgttgtcatcttttaactaaggccatttctatcatcctgaattcaagagattattgagaaaatcttccaaaaaaaaaaaaaaaaaaaaaaaaaaaaaaaataacatcgcgagctttaaaaatatcaa

SEQ ID NO: 79605 - DNA, 438 bp, Zea mays
  Clone ID: LIB3088-046-Q1-K1-G11
atcgccccagaccacagcgcgacagtgagtacagcagcagcagctgagagcgtgcgaagcaggagggaggacaagaagaagccgatggcggttgtgagcggcagcggcgggaggctgaacccctgggcggagcccttcgttccttccggggcgcggtaccgcggcctgcggaccatggaggcgacgccggagcatgaggtggaggacttctcccccgagtggtggcgcctggtgtccgcctccccggccttccgcgaccgctggctgcgcgagtacggcgcgctcggcctactcgacgccgaggacgacctggacgacgacgtcgacagcttcctacccgacgacttcttctcgcccccggccccgcgccacgagagcgagcgggaggacgccgtgggcaggatggcgggccgagggcttgaggtggcggcgttgggc

SEQ ID NO: 79606 - DNA, 435 bp, Zea mays
  Clone ID: LIB3088-046-Q1-K1-G12
ctcagcatggccattctttggctagtgatcaccacagatattatcaaccagggcttacacgctgagcctcggcagcttcctcttgttctagagcctcgatatgttccgccggccctagatcatcatcatgtgccagagcttcgacatgccccacctgcatattatcgcactttggctccatctggtgattcatactatcggtctgttgagaatctggtgcctgagcgatatgcagacagaaccatggctgacttgaccactagagatccaattattagggatcacacagcactaccaggggaggcacttgctcgagcagaccgcttggatgatctctaccgttctgatcgtgtggaggaactctaccgttctgatcgacttggtaaccgtgcttgtggaccgcctcatccagcctattttacagctgcttatgag

SEQ ID NO: 79607 - DNA, 366 bp, Zea mays
  Clone ID: LIB3088-046-Q1-K1-G2
gccccaaagcttcatgttttcagacctggcagatgatttcaaccaaaatgcaggttgagcgggtcatgcacagcgtaccaaccatttgtacataggctcatgggcagtcgaatctgcattggtgaagaacttgaggaccttttgatctagcttgtttatttctctagtttttgcgtcttgatattgtggctagtttggggcttcgggtctggtgggttgtctagcccatcagaacgcgtaatgggtattggtcttccagtatgttttcagcgttaatttggctaatttccccgcttggcttgtacaacaaattttatcagtactgactaccatgagttgtactgctctatatgctgctttccactc

SEQ ID NO: 79608 - DNA, 399 bp, Zea mays
  Clone ID: LIB3088-046-Q1-K1-G3
atcgggcttcctaggcccgggctgacacccatgggagccccagctgacgcatatccatactactacatgccacagcatcaggtgcctggtcctgggatggtttatggcgcccagcaaggccacccggtgacgtatctgtggcaggatcctcacgaacagcaggagcaagctcctgaagagcagcactctctgcatgaaagggactgaggatgtcgctcaagctatcacctgatttttcagagctctcattttaggttctctaaactgcaggttttcgttggctaatatcggtgggtatcaaactgaaacaggtagggtgtagcatcatggtagtttgatttctgctgtggtgttagttggagggataatgattagcggctagtggattaaagttaccca

SEQ ID NO: 79609 - DNA, 365 bp, Zea mays
  unsure at all n locations
  Clone ID: LIB3088-046-Q1-K1-G4
accacgcgtccgctgttgtcgtagatctcggaggtaggtagatggaattccccattgcaattactgggggtcatgttctgctgaaacagctgcaacgttctcgaattttattgcccttaagcacgattggtttgggattatccaatcaaagaactgttctgcacaccttcagagcagaaacaggcgtcatgttgtggggggaggccacaagagcagtagtgtcggccaatgcagcaggaaaccaccgctcgtttggtcttttggtcgcggagcttggaaagcataatcaattgttctttatgggctgatcgattctttcggaacggaggcatagaataattcctaagccggttgnttctctgatt

SEQ ID NO: 79610 - DNA, 348 bp, Zea mays
  Clone ID: LIB3088-046-Q1-K1-G5
cccacgcgtccgctcaaccatcacttcagaatccaggacaagggcttcggcatcacctcgtcgctttgggacgctgtctttgggacattgcctccatccatgacgtctgggaagaagaactgacgcacgtaactcaattcttggcatgagagattctaggggacctgtaatatatattcaagctagggataatcctggatctgtcttcgtgcgatgggttgacatgttcattcagttctcgaagttcttgtagtgtactgattgtctgttgatctaaaaaaaatcacctttaaattcaatactttagtcaatagaccatatttaagatagagaaatatcaaaacaaaa

SEQ ID NO: 79611 - DNA, 360 bp, Zea mays
  Clone ID: LIB3088-046-Q1-K1-G6
gaacttttgcctcttgggtaacacaaattttccactgccagtctgcatttcatttctgcgtgctagtattgaaccaacacggtttcctccattgctggataaaaatcaatggaatattaccaagattgtagctgagcattaaatgctatatatgtaccttaattgctactataggctattttgacgaggacatacctaatcattcaagtccataacttggatgatatgcaataacatgcgcacattacttctagctggcggtaatgatgagtcatgagatgtatggagtttcatcggaatgaaacatcgtcacgatctgactcatattacagaaactactctatatgcttctttgatttc

SEQ ID NO: 79612 - DNA, 270 bp, Zea mays
  Clone ID: LIB3088-046-Q1-K1-G7
tccacgcatgctcgaactaatgctgcaactctgaatgcatccactgatgattgcaatggggagtgttcttctgtgaattcaccttcgaattgccgatcgaatcatgatacgcatgacgacatgctagaactgttgggccctctgcttggcactagttctatcgctaggcgtaaagaaatacttgctgtcatactaactgtgtctaggcttgactttacacttgactagtcaactgcttattcagaagctctatatgaatctgaacatgga

SEQ ID NO: 79613 - DNA, 296 bp, Zea mays
  Clone ID: LIB3088-046-Q1-K1-G8
cggacgcgtgggcaccagcgctcgtcacctccaatcaacaaattcccaatgggccgcttaccataccgcgttcgccgctccatttgatcgaattcccgatggcgcccaaggccgacaagaagcccgcggagaataagccgacggaggagaaggccgcgaagaagcccagggcgcagaagcgcgtgccgggcaaggagggccgcgagcagaaggggaagacgaaggcccagagaaaccgcgctgacgtacacgatctacatcttcaacgtgctcaagcaggtgcacccggacatagg

SEQ ID NO: 79614 - DNA, 407 bp, Zea mays
  Clone ID: LIB3088-046-Q1-K1-F11
gttataaaaggttggaagaagataatggtgtctcacaaaactttgcgaagtgggggtaagcgggagatagctaaatgggtaatgcatcagtatcaccttggaaaagaggaagatgaaaaggacggggagcttgtagtatctaaaatcttcttccagttggcaaataagagtatggaaatttctgaaacagaaactgcttgtgaagaacctgaagcacctgcttcagtgattggtccgaaaactccaaagacaatcacaccgcagccacgtcatcctaaaagtagtccatgtgaaactcagcagaatatttccattgtgcaggatcagctactactggacagcgaaagcgagcctaccatgcctattgttagtctggaggatgatgctatgaaccctgcatggtgtgc

SEQ ID NO: 79615 - DNA, 151 bp, Zea mays
  Clone ID: LIB3088-009-Q1-K1-B6
gaacgaaaggataccaatatatatgtagcgtcagtcttaggatcctggttggtctggcgggccggtgtgggtcacattggaccgggtggtttctgtccatgaatgtcttgaacagcaaaaattggttcatttatcatgatatttttcaatt

SEQ ID NO: 79616 - DNA, 414 bp, Zea mays
  Clone ID: LIB3088-009-Q1-K1-B7
acggtcaccggtggcgaactcttcgacaaaatctcctctcgtggaaggctgaaagaggatgacgcaaggaagtacttccagcagctgatcaacgctgtcgattactgccatatccgaggcgtctaccaccgcgatctcaagcctgaaaatctcctgcttgatgctagcgggacgctcaacgtttcggattttggactgagcgcactatctcaacaagtccgagaggatggtctgctgcacacaacctgtggaactcccaactatgttgctcccgaggttataaacaataagggctatgatggagctaaggctgatctgtggtcatgtggagtgattctctttgtcctcatggcggggtacctcccatttgaagattcgaacctgatgtcgctctacaagaaagtttgccagtct

SEQ ID NO: 79617 - DNA, 295 bp, Zea mays
  Clone ID: LIB3088-009-Q1-K1-B8
cgacccacgcgtgctcccactcttcctttctcctttcctgcttcttcatcttctctccaagggcccccccttcggggagtgcggcttcttacagacgagcggcccctccatcttcttccactccatcatcttcttctccctcgcctccgtcttcctcatctccatcggggtgcacatcaccacttactatccgtctagccccatagccgggacccagatctttcttcgttacagtctgcctttatatacttatatacatacattctcatttacattccctctaccacttttttca

SEQ ID NO: 79618 - DNA, 399 bp, Zea mays
  Clone ID: LIB3088-009-Q1-K1-B9
acctaacattttttattgaactgtatattacaactaacggcggggcggccaaaactcaaggtttgatcccctgatcaaacgctgggactgaaacacatgattttaaccatctaaccacatcattgtccacgcactattcaagatcccgtgtcagacaacaggttgccatggtgaagaagcacatgacagagaccgagtcaatacccttaccaccaccattgctccgtgctaaagacccgtccaagctggatccttatgacctatcaaaggtttatttcccgcacgaagttcgttcttgactcaagctcgtcatcaccgaccacccacacctgaggcgacacgcgacaattaaacgtcacactgcagcgctgtcttgatcctcttgatggtgcagaatat

SEQ ID NO: 79619 - DNA, 356 bp, Zea mays
  Clone ID: LIB3088-009-Q1-K1-C1
aaaaaaaaaaaaaaaaaaaaaaaaattaattaaaaaaaaaaaaaaaaaaaaaaaaaaaaaagaaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatattttaaaaaaaaaaagggtgggaatttttaaatttactaatcttttttagccttttttttaaattttaattctttttttatttaacaaaaaattaaattaatcttccccctttttttataaaatcatcttattttaaaaaattttactttaaatatttatttttttttaacattattacccttttt

SEQ ID NO: 79620 - DNA, 363 bp, Zea mays
  unsure at all n locations
  Clone ID: LIB3088-009-Q1-K1-C10
gcaccatgttgttcctgaaattacctcccttcagaactccgaaagtcacttcacggtacgttccattttcatgcgccggagaagagagtactgagaggcgacaagaagatcactagacaccactgtccggtctaggctatcttgagaaaggcttcttggtgggctaaatgacgaaagaaaatatccaggactgggtggtcattcaaacatcaactgagctatccagtagccaggttttaagtgtgttgtaatgcttcaatgtgtttcattttccaaagacctgagcttcgcttgtgatttgttccgagctgtacggtgtcgattttgtgtatataatataatataacgaaataaagggtnntt

SEQ ID NO: 79621 - DNA, 428 bp, Zea mays
  unsure at all n locations
  Clone ID: LIB3088-009-Q1-K1-C12
aaaaaccggcggacgaacaaccccacctccactctccaacatttttcnnacntcatatnccacagggagggctttttacatggcggagccgcccctcatcctactacctcattatcttctcaacttcatgtagctatattctcacttcttcaccgttatataaatccttttttcttcaaataacgattttaccaatactgatgacaacttatactctctccatattgttcatcaaataattttataattactcctacctctttataatgaactctttatcattaatgccatcactattcccctatacttattctttttcctaattaaatttcacaattacaattttacatctttttactctttttttactttaacattacatcctttacatttattcccactcttccacttctaatatcatccttttt

SEQ ID NO: 79622 - DNA, 400 bp, Zea mays
  Clone ID: LIB3088-009-Q1-K1-C2
cccacgcgtccgccgagagagtcccccagttggttttatgtgcccaggtggctggaaggggctcgttgaatactatgacagcttggtgccatctgagggcagcagcaagctgcgtgaaccaattgcagcctaaaatctggaaaatccttcatataaggaatgctactatatcttagcaagcggttctttgcgacatagaaccgatgctatatgattgtatactggctgtaagactttaaaacactaggcttgattcggatgttaatgtgtgctttgtacccggtgtaccttctctgctggcagtgttgcacatgcactggagcacatcaaacgtttggtgttaataaggacaggctatgtatcatctgccagattgtacatatatacattggggtgatat

SEQ ID NO: 79623 - DNA, 315 bp, Zea mays
  unsure at all n locations
  Clone ID: LIB3088-009-Q1-K1-C3
cgacgcacgcgtncgctccaaactcatcatatcccctagcgccttcggtctcttcagcctcgcacacagggcgccagcccgagtgaccggtgcagcctagggtttccggcggcgatggcgggtaagggagggaagggtctgctggcggccaagacgacggcggccaagagcaccgactaggacaaggacaggaagaaggcccccgtgtcgcgctcctcccgcgccggcctccagttcccggtgggtcgcatccaccgccagctcaagtcgcgtgcctccgcgcacggtcgcgtcggcgccaccgccgtcgtctat

SEQ ID NO: 79624 - DNA, 368 bp, Zea mays
  Clone ID: LIB3088-009-Q1-K1-C4
attacctcctttcagaactccgaaagtcacttcacggtacgttccagtttcaagcgcgcggagaacagagtactgagaggcgacaagaagatcactagacaccactgtccggtctaggctatcttgagaaaggcttcttggtgggctaaatgacgaaagaaaatatccaggactgggtggtcattcaaacatcaactgagctatccagtagccaggttttaagtgtgttgtaatgcttcaatgtgtttcattttccaaagacctgagcttcgcttgtgatttgttccgagctgtacggtgtcgattttgtgtatataatataatataacgaaataaagggtttttattaaaccccccttaattaaaaa

SEQ ID NO: 79625 - DNA, 216 bp, Zea mays
  unsure at all n locations
  Clone ID: LIB3088-009-Q1-K1-C8
ctttttctgcaacccattccatnccnncggaaagattgtttataataggggtcgaccccanccancattattatntgcttatcttttatctttactagttttgtcttcctatatctttctttctttctcccccccctccctcctttcgactctttactgaaacttcttatagattctcaatatttttttatcttattcctatgctactttttaaaa

SEQ ID NO: 79626 - DNA, 157 bp, Zea mays
  unsure at all n locations
  Clone ID: LIB3088-009-Q1-K1-C9
gaccctgggaaaaaaaaaaaaaagattttaaaaaaaaaaaaaaaaaaaaaaaaaaaagaacggtttaaaaaaaaaaaaggaaaaaaaaaaaaaaaaaaannnaaatttaaaaaacgggccgccccttctaaaaaacccaaacttacttccccttcct

SEQ ID NO: 79627 - DNA, 229 bp, Zea mays
  Clone ID: LIB3088-009-Q1-K1-D1
gcgtccattttttcatcttattcaggtccactgcaccccctgctcgtcactctccagggcccgtatcaaggggcacgagctgcactgaaagagcaagacggatcttcaagcacatctcaaagagcttaaataaaaactcttcctcctacgcgtggacaatgtaaccggcggggctgccaacaagctctccaaaatcaagattgtgcacacctgcatcgctcgcgtgctc

SEQ ID NO: 79628 - DNA, 345 bp, Zea mays
  Clone ID: LIB3088-009-Q1-K1-D12
gcacctggtgctccgcctcaggggaggctccaagaagcgcatgaagaagacgtacagcaggcccaataagatcaagcacaagcacaagaaggtgaagctggccgtgctccagttctacaaggttgacgacgccaccggcaaggtcacccgcctccgcaaggagtgccccaacgccgagtgcggcgcgggggtcttcatggccaaccacttcgaccgacactactgcggtaagtgtggcctcacctacgtctacaaccagcatgcgtaggatgcccctcctttctgtcgggaaggaaaatgggaagtctagctaggtgataatcctttcagatttgttctgatttg

SEQ ID NO: 79629 - DNA, 212 bp, Zea mays
  Clone ID: LIB3088-009-Q1-K1-D2
acttgacccagcagttaatggaacactctttgttctcggttcatgcatgaaagcggctagtaaaattgtggatgtggcatgctctatggctactacagcctacaacacgaggccaaggactcctgaagtcacactttacctgacatgggttgccgatccaactttctgtgctaccaacaagctatccaatatcatgatcgagaacccctcca

SEQ ID NO: 79630 - DNA, 302 bp, Zea mays
  unsure at all n locations
  Clone ID: LIB3088-009-Q1-K1-D3
ccgtccggnaatgttgtgaagtggtggagtcaacaggtatcctnntttgttgaatcaagnncttcttggagaaggattgggtctaactgatagaagataaggggtgaatattannnnattgctaaanncttatacaattttattgtcatacattaccaggatatatttaatttctanncagagaaattgttcgacngnngtagtcttatagatgcattgtcctgcatcttttacgagatatggttagtcatttttgaccattttgtcaatgatctaagcatannggtatttgnnngatgtta

SEQ ID NO: 79631 - DNA, 383 bp, Zea mays
  Clone ID: LIB3088-009-Q1-K1-D4
aaaaaaaggttatttcctggcccaataaaatggggatttggggaaggtccaccgtctggacgtataccaagcttaaactactggtttagagctcgaggggaactctcagacgaccaggctctacacagatgtgttgtagcatatgcttcggatctactattttctggggtgagccttaaccctcatcgggagaagggtttgaagacatactgcctcagtcttgaccattccatctggttccacaaacctgtgaaggctgacgaatggatgctgtatgtgatcgagagcccatctgcgcacggtggtcgcggtttcgtcaccggacgcatgttcaacaagcaaggagagcttatcatgtcgctgacccaaaaggcattgattcg

SEQ ID NO: 79632 - DNA, 383 bp, Zea mays
  unsure at all n locations
  Clone ID: LIB3088-009-Q1-K1-D5
tgagantttgggaaggttcancntctggacatatacgaagctgaaactactggtttagagctcgaggggaactctcaaacgaccagtctctacacagatgtgttgtagcatatgcttcggatctactattttctggggtgagccttaaccctcatcgggagaagggtttgaagacatactgcctcagtcttgaccattccatctggttccacaaacctgtgaaggctgacgaatggatgctgtatgtgatcgagagcccatctgcgcacggtggtcgcggtttcgtcaccggacgcatgttcaacaggcaaggagagcttatcatgtcgctgacccaagaggcattgattcgaagggagaagccgggaggtccaaatccgagt

SEQ ID NO: 79633 - DNA, 101 bp, Zea mays
  Clone ID: LIB3088-009-Q1-K1-D6
ctggaacacctgcagaagcatctcgattcgtccttgaagcacataagatctacaaggacacaacacatggttgatcaactgacagaacttcagaaaaagga

SEQ ID NO: 79634 - DNA, 420 bp, Zea mays
  Clone ID: LIB3088-009-Q1-K1-D7
cgcaaggctaatgttgatttcaaccagcatccgtctgataacttcgaccctaataacccgtatggggacccggtggggatggtcgagtaccgggaacacctggtgcgagagaagtggatccagatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagaggtgatctgacccttccattgagttgaatgaagtagcctggaactgtggtagttcgtcttttaca

SEQ ID NO: 79635 - DNA, 144 bp, Zea mays
  Clone ID: LIB3088-009-Q1-K1-B5
tcttactcgttggaaaaaaaaaaaaattaatttaaaaaaaaaaaaaaaaaaaaaaaaggaaagttttattataaaaataaaaaaaacaaaaaaaaacataccctaaattacaaaaccttaaattattttataataactcctaaa

SEQ ID NO: 79636 - DNA, 426 bp, Zea mays
  Clone ID: LIB3088-008-Q1-K1-H8
gcgcccacgcgtacgtagccctacatgtttcaagtgcagtcaaattgggcattatggtaatgcttgcccgatggggaattctggtacaccagctaagaacaagcaatagacccctggcaagggatattctatagccagggtgaatcaagtcagcgttgatgatactcctgatggtggtgacatcgtacttgacgagcaagccactgtggaatctgaggttcaacaagtagagatagctgagcaggagctcattgaaggagaagaacaggtggtcgaagaggagccgactaacactgaggcattcgacttgatctacgtggtgtttctcaatcgacattggcgccgacaatccttagttcgttttacatttattattttactttgtaataagtctttcgctatgtaataaacactctgatgatttat

SEQ ID NO: 79637 - DNA, 247 bp, Zea mays
  unsure at all n locations
  Clone ID: LIB3088-009-Q1-K1-A1
cccacgcgtccgagcgtccgggaggaaggcctccccgtgctgtggcgcggcctcngcacggccgtcgcccgcgcgttcgtcgtcaacggcgccatcttctccgcctacgagctggccctgcgcttcattgccagcggcggcggccccaggctggtcatggaggacaagtgagtcagactggaccatgttgtacataggctagtataagtatccattccagtggttggtggagagtatccatnatccc

SEQ ID NO: 79638 - DNA, 54 bp, Zea mays
  Clone ID: LIB3088-009-Q1-K1-A10
cgttaaactcatgcccttcttgttcataaataatttttcacacaaaaacaaaaa

SEQ ID NO: 79639 - DNA, 338 bp, Zea mays
  Clone ID: LIB3088-009-Q1-K1-A11
gccgccgcctgaatgaagggagccgtatcccggttggccgtgggccgtggctgctgctggggagagggagtcgtcgaccagcatgcgtccaccgtgtcccggctggcagctggcacttgaatgcagcagctttggttctttcctgtgcggtcgtctcgtgagttgttgtggccctctctcctctcttgtttcgctgtggttggcgccatgcgaggtgaatgcgatctcttgcctggtgctgctccagtgcttccatctgcttctgctgtggatgggtcactctgctttctcctctgtggtgtaagactgtaattaacataagaatgggatttcattgc

SEQ ID NO: 79640 - DNA, 347 bp, Zea mays
  unsure at all n locations
  Clone ID: LIB3088-009-Q1-K1-A12
ttttatgctcgcccttcgcttttacctacagacttaactcacgaggaagcttttttaaaatggtgccggccacacccacctttccttaacttcctcaactactaccttctactccttttcttttaaaaaattacaatgcttaaattcaaaccattttttctttatacatttncaatcttaattaattttttagattccagtcctattgtttttgccttctatatcccaatatataattaatatttacattccttttcattcttattttcatattcacaaatcaaattctttgatttatgaaagacgaacaacttctaaaacattttccaaagatgttttcattaatc

SEQ ID NO: 79641 - DNA, 329 bp, Zea mays
  unsure at all n locations
  Clone ID: LIB3088-009-Q1-K1-A2
gcacgnagcttctgcagcaggagcagctgctgcggccacagcatgctgaagctgcccgagagcgtggttgagtagtagtagtgctgtagtaaggtggaaattccaccgtgggagaagggtgtgcacatatgaacaagcaactgtgaggtgagtgtgactcgccggcgtaaatgtagactaagatcgccggtgcagggtgtttgatctagtagtctagttactatataggtttgctggagaaaaaaatgatgtaggattttgactgagcagagcagggggtctgaaaggtggaaaanaaaaaaaaaaaaatatttatttttaaaataaaa

SEQ ID NO: 79642 - DNA, 422 bp, Zea mays
  Clone ID: LIB3088-009-Q1-K1-A4
gtgatctgaaggccaaaatctgtgctcatgacccatcagattctgaagatattgagggaggcatccgtaattctctcttgtggctgcgtgatgaattacgaactcttccatgcacttacaagtgccgtcatgatgctgctgcagatttgatccatttgtatgcttatacaaagtgctttttccgagtccgggattacaagacagtaaaatctccaccagttcatatcagtccgcttgacttaggccccaaatatgccgataaactgggaccaggctttcaggagtactgcaagacatacccagaaaattactgcttagcccagcttatctattggtatagccagaattcagaacctgaatctagattgacaagagctagaaaaggttgcatgtcattgcccgatgtctcgtccttctatgtg

SEQ ID NO: 79643 - DNA, 428 bp, Zea mays
  unsure at all n locations
  Clone ID: LIB3088-009-Q1-K1-A5
ttcaaatatggtccttcagtggcaagcatctttacaaggtgtcaaaggatcatttgtatgagtttatatggcgcgccgagaccgccctcactactgacggccgagaaggaagaagagatctcaaggaacctgaagaagtatagcaagaagtacgaacaagaagaccaggatgcattcaatcagttgagcgagcaggaccgcaagaggcggacacagcttcaggaagaatgggactcatgggttgccaagtggaagcagatgcatgaggaggagcgtgtttacaggagggagctcanggatggggaggccagcgacgacgaggaagagtatgaggccaaggaagttgaggtggaggaagtcgttgatgtccgtcaagaagttcttgcattcgacctagatcaggagtgaaaacacttatcatagaatct

SEQ ID NO: 79644 - DNA, 314 bp, Zea mays
  Clone ID: LIB3088-009-Q1-K1-A7
ccactccttgagcaactaccacttgcactttatgactttacaaccctaccgtggaggttctcttgagcatggcatgcatcctccaatttcccccaagccagaatggcgtgctccgatggatgaaatggctgttgtagcaactaaagaatatcgatcaattgtctttcaagagccacgcttcgttgaatacttcagatcggctacgcctgagactgagtatggcaggatgaatattggcagccgtccatcaaagaggaagcctagtgggggaatagaatcgctccgcgcaatcccatggatctttgcttggacac

SEQ ID NO: 79645 - DNA, 357 bp, Zea mays
  unsure at all n locations
  Clone ID: LIB3088-009-Q1-K1-A8
gacgcgnggggcgagagaagctgttcttgagaaacagaagcaagaggaggaggaaaggcgtaaaaaacaacttgaggaagaggagctagagtccagtctcacttcgaagcaagcatcattaccaccggaaccgtctccagacgcagaaggtgctgtgacagttgtagtccgaatgcctgatggtagtcgacaggggcgccgctttctcaaaactgataaacttcagttcctatttgatttcttagacattgggaggacttgcaagccagggacctacagattggtgaggacatacccaaggcgcacgtttaccaacagcgagggtgacgtatcattcagtgatcttggcctaacaag

SEQ ID NO: 79646 - DNA, 279 bp, Zea mays
  Clone ID: LIB3088-009-Q1-K1-A9
gatcgcgatcccccgcttcttctggattgctcctcttggagcaatgaactttgcaggctgtgagcttgccaagaaggcaatgataaaagatgagaaaaattccagtgagtcaacacgagagatcttgccaagaaagcagtgatcaaccatgcaacttttttattttatttttgggtccatgttgcagagaagcaacagaacatctgcctttttttgatattgggaattacattcccgtagggccttgagatggctgtatagtatacattacatgagaaa

SEQ ID NO: 79647 - DNA, 216 bp, Zea mays
  unsure at all n locations
  Clone ID: LIB3088-009-Q1-K1-B1
tcagatcatagcgtagctcagcttgaatataactgtaacatcacgcctgttttgtgaaagctcgtgccttgctcaattgtgccactttagcagacatccccagctcacctcatcctggctggagatcatatcatatgcagatatgaaatggaacgttggatcagagttttagtggacgctcaattttttttgaggtagcngcnnataaaaataaaa

SEQ ID NO: 79648 - DNA, 363 bp, Zea mays
  Clone ID: LIB3088-009-Q1-K1-B10
aaacccagtaactcgtattttcctccgtgatccaagttctagcagcgcaacgctcggttgggagaatatgtcggggcgcggcaagggcggcaagggtctgggcaagggcggcgccaagcgccaccgcaaggtcctgcgcgacaatatccagggcatcaccaagccggcgatccggatgctggctaggaggggcggcgtcaagcgcatctccgggctcatctacgatgagacccgcggtgtgctcaagatctttctggagaacgtcattcgtgacgccgtcacctacaccgagcacgcccggcgcaagaccgtcaccgccatggatgtcgtctacgcgctcaagcgacagggccgcacccttta

SEQ ID NO: 79649 - DNA, 358 bp, Zea mays
  Clone ID: LIB3088-009-Q1-K1-B11
cggacgcgtgggctcgacgtcaacgcccaggacgtacaggcgtacatggtcggcgagcgcggcgacagctcggtggcggtgtggtcgagcgtgagcgtggcggggatgccggtgctcaagtcgctgcaggagagccaccgctgcttcgacgaggaggcgctggagggcatccgccgcgccgtcgtcgacagcgcctacgaggtcatcagcctcaagggctacacctcctgggccatcggctactccgtcgccagcctcgccgcgtcgctgctccgggaccagcgccgcatccacccggtctccgtcctcgccagggggttccacggcatccccgacgggaacgacgtcttcctcagcc

SEQ ID NO: 79650 - DNA, 247 bp, Zea mays
  unsure at all n locations
  Clone ID: LIB3088-009-Q1-K1-B12
cccacgcgttctcggacgcgtgggccatgccccatgggacgaaggtgatcaccatattagtttgttggtaggcgaggagtcgggtcgaggtagctttttagacgaccgaaaggcgaaaataagttgaggatctgcatcccaaatttgtgatgtaaactgagacagaacagcagccaaatgaagcagagatttgctgaaagattctgtaactggttgcagctaatgttgaatgcagtttgcccanaat

SEQ ID NO: 79651 - DNA, 418 bp, Zea mays
  Clone ID: LIB3088-009-Q1-K1-B2
gtcgccgaccaaggactgacggaacggatcggatggattgggagattggcatcgcaggggattctggatcagattgtcttcgagcgcacgccgcaatggtcaactgcgcagcgctggcttggctgtcagagcgaaacagcggtaacagagcaagacacgaggggtctgcactctgcagttgtgcaggaggaggaacagacacaaggggaggacggcgcgcggccggacatggcgtggaacagagatcgtcgtcaccgccggcgggggtgtggtcgacgacgcgacatgcgaaacactacgtgctagctagcataggaaaaaacaacatgaaatcgtacaaccaaccaatccctcgcactgttttaagtgttagctgtaggcgaaactggtcatccaattgatcaaatgaaacttattt

SEQ ID NO: 79652 - DNA, 433 bp, Zea mays
  Clone ID: LIB3088-009-Q1-K1-B3
aataccggggcggacgcacgcgtccggccaccacacctcctcctcctcctcctcttagcacagctagcgcctgctcccctgcgccgttgatcatgtcttgcagcagcggcaagtgcgactgcggctccagctgctcctgcggcagctcatgcaactgcatgtcccctaacgtggagaccgccgccgccagcagcatcaagaccatggtcctcgctgcgccgaccaccaaggccagcgccggcggcttcgaggcggccaccgagggcggcggctgcgactgcaacacctgcaagtgcggcaccagctgcggctgctcctgctgcagctgcaactgagcgccggccggcccggcgatggcgcgcacgagtcgacggaaggacgacgacgagtcgtataaatataatagcggcgtctatataagatcctgtcaact

SEQ ID NO: 79653 - DNA, 333 bp, Zea mays
  unsure at all n locations
  Clone ID: LIB3088-008-Q1-K1-H5
agactgtacagctgaactagactgggcctcacatgcggtaattgcctaattgctcaactgtccacaccttgcgtgataactctgcgagttacacatatataatgcatacggtcaatacaaactgtctacgaccccttcatcgacgccgacagcctgttccgcagctctggcaccaccagccaccagcagactcgcatgtcggagctagtcggcttattctgccagacttcccacgaaaccaccggtggatcggcgactgctccggatggaccgtntgcctgaggatactgccgagtgaaggaacagcaacggacggtcccaacgtactatgga

SEQ ID NO: 79654 - DNA, 268 bp, Zea mays
  Clone ID: LIB3088-008-Q1-K1-G1
gcaatcactggacctatcggcaaggagtgtgctgacctttggcctaggatcgccagtgcagcaaatgccatcgtttgagagcttgttggaatgtgtttagacttgagtatgatcatctcaattgtgtgttgcaggtgttgtaagggtgctattggacttgatggctccttttatgtttggtcactcaattctgtagtgaacagaaatttctggttgcctcaagtttgctgtctgagatgcttatattatttattttgttctatggtgg

SEQ ID NO: 79655 - DNA, 422 bp, Zea mays
  Clone ID: LIB3088-008-Q1-K1-G10
gtcaagtgtgccttgcttgatgcaagttgtgttttcgtatcattattattatgcacggccgtcgtacgtgtatggcttgtatgggttattgccaacttaataaaagcacactctgtttgcctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgtttaaaaggaccaaagtttacttcccctgcattccaacctaaaagtttttttatagggtccccaaaattaaattaaggggccgcgttttaaaaacgtataaattggaaaacccttggcttacccaaattaaatccctttgaaaaaaatccccttt

SEQ ID NO: 79656 - DNA, 436 bp, Zea mays
  Clone ID: LIB3088-008-Q1-K1-G11
aatatttcataggagttaaagtgcacatacctaatcaagtctgtgggtctccaattctgaggtagaaagataatttatgttctcatctttctgaaatgaacaagatgactggcttatgggttaaggtttttttatagagcaccatgacttatcagttttgtgaacaaccctaacttatgtggtcctggcaccacaaaaccttgtcctgatgctcctcccttttctccacctcctccatacaaccctacaaccccgatgcaatcaccaggaagtagctcttccactactggagcaattgttggtggagtggctgctggcgcagccttgctatttgctgatcctgctatcagttttgcctattggcggcacaggaaaccacatgagcaagcatttttttcaatgtatctggcttcaaagttagtctttgattattatc

SEQ ID NO: 79657 - DNA, 438 bp, Zea mays
  Clone ID: LIB3088-008-Q1-K1-G2
cggcaccctgaggtgaagtgggctcagatgatcgacaaggtttacatcactgtacagttacctgacgcaaaggatgctaaggtcaatttggatccagatggtgtcttcacattctctggcagtgctggtacaaacttgtatgaattgaaactagatctgaatgacaaagtaaacgttgaggctagcaaaataagtgtgggggtcaggtccatattctgtatcgtagaaaaagctgaagccaaatggtggaagaaactcgttcgagatgatcaaagggcacctcactttgtgaaagttgattgggacaaatgggttgatgaagatgatgatggtgctgatatcaacatggatgggatggacttctcgaatttcggtggcatgggtggtatgggcggcatgggtggcatgggtgatatggctggtatgggtggtcttggt

SEQ ID NO: 79658 - DNA, 359 bp, Zea mays
  Clone ID: LIB3088-008-Q1-K1-G3
cccacgcgtccgcccacgcgtccggatccgagatgtgattgctttccccaagaccacgagtgctcagtgtgcactcaccaaagcaccatcagctgtagaaccacagcaactgaaggatctcgccttccccaaacctacttcgtgagacgctgttcaagtgttcatgacaaaaactccgtgctctcaaggacagctatagtttgcttctagttttcgagtgtattggcctattctatttttgcatagtatagaatgcgcagtttttggaccgtaataaatttatagaagatgcataacacgccaaagttctggaagagcattgttttaattttgccgtaatgaaaatcattagtgttcag

SEQ ID NO: 79659 - DNA, 391 bp, Zea mays
  Clone ID: LIB3088-008-Q1-K1-G4
aacttgatattgagctgagtggaagttaccatacttaattgctttgaattgatttttgtggagatatgacttgactaaacatctaaagcagctccagtgtagaaccctgatttttgtcagtgagaattctcagttaaactcccaagaccgttcattggacatcaaagctcgacatgagatattgtgctctagttgaggtttgtgcgtcaataatacttttttatcaaagttcactcgaggaatgcaagaattaggataggccaattagatcttttttattggtgtatactgagtttcctctgataaggaccctgtgtcaccacctgggtcaattttactaaacatttttgccactagccttaaatacatactacaaagtctgatttacgct

SEQ ID NO: 79660 - DNA, 361 bp, Zea mays
  unsure at all n locations
  Clone ID: LIB3088-008-Q1-K1-G5
ctgcacgcagctcagtctcgtccatccagtgctgtagaattttctttggtctgtgggcagggcagccatgaaaccccctcagctgccggcaggggagggggcctcctgggctcacgaggtcaagcaggccctccgtgagaaactccggcgctcctacggcgccggagctgcctccgtcacaccggaggccaggccggccggcgaaccaagccgtggcgctgagtgccgcggctcggcggccgaagaccccataaggagagtcatgttcttggctccctggggtcacacataagaacacaaacccgccggacgagatctgggcatgcaagcttgcatggccatgtnctggtcagtcagatct

SEQ ID NO: 79661 - DNA, 378 bp, Zea mays
  unsure at all n locations
  Clone ID: LIB3088-008-Q1-K1-G6
tggtgataggagcagcactaacaagacatataaagatgaagatgaagcttcagaagatgcatttactaggagaacaaggtctcccactaaggaagaagaaacaatcactaatccaactgatcgtatagtggcctatttgctgtttcatagacattgctcccaggttgcatcagcaacaaaagaagaaatcatatcctcaacccccttgacactagaacctgagctgaaagtaccattgggaactactatggtactatcagaagatcaactgcantcagaggatcaacgagatgagcaaaaaaatgcgttgcagccgtcacaataagatgctgattgatcaactgttcagtatcaatatgatcgcaatacccgtgatga

SEQ ID NO: 79662 - DNA, 379 bp, Zea mays
  Clone ID: LIB3088-008-Q1-K1-G7
cggactcgtgggcggacgcgtgggctggattgcagttttattttatgttcctgctgtaaggtgacttgccgagacatagttatcattggttatctataatagctcaatcgactcgtgcaatctgaaggctctgctatatgcggtaaggtcgtctatgtaactttgtcatagttgatgtcagacggctcaaatctgaatgctatgtatatgtggtaagttcgtctatgtggttgcgtcgtctaaaatgcgcagtttttggaccgtaataaatttatagaagatgcataacacgccaaagttctgtgagagcattgttttaattttgccgtaatgaaaatcattaatgttcaggggcggccattttaaaggtcccacgttt

SEQ ID NO: 79663 - DNA, 335 bp, Zea mays
  Clone ID: LIB3088-008-Q1-K1-G8
aaacagcttactccactcatgtcctgaagtatggcagtatttcctccgttgcatatatgttgttggaatatattcgtcatcagcatttttgtgcaaacatggagcaccggtggtgcttgacatccttaaggcactgtctggtgcaagtgcaacagctattccgtaggaagttaagagcttggtcagcgggaacggcaactccctaggccgcatatttttggatgacgcaaggaagtagcttgattgtttcgcaccgtgttttccctagcgacttggatgacacaagggatgatgcttccattatacagtagagtagtgttggtgacatgtacgca

SEQ ID NO: 79664 - DNA, 436 bp, Zea mays
  Clone ID: LIB3088-008-Q1-K1-G9
ctcgactctcctctctcgcatccgcagcctctcgagctctactccatcccctcgatctcgagagcgcagcagcagcagtcaggcggccatggacgccagcgcagcaggagccggcgggaaggcgaagaagggcgcggccgggcgcaaggccggcgggccgaggaagaagtcggtgacgaggtccggcaaggccgggctgcagttccccgtcggccgcatcgggcggtatctgaagaagggccggtacgcgcagcgcgtcggcacgggcgcccccgtctacctggccgccgtcctcgagtacctggccgacgaggtgctggagctggccggcaacgctgccaaggacaacaagaagacccgcatcatcccgcgccacgtgctcctggccatccgcaacgacgaggagctcggcaagctgctgtccggcgtcaccatc

SEQ ID NO: 79665 - DNA, 319 bp, Zea mays
  Clone ID: LIB3088-008-Q1-K1-H1
tcggacaataccaaaaaaaaaaaaaaaaaaaattaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggcgccccttttaaagaatccaactttactttcccttcattgcaacttaataccttttttatagggcccccaaaatcaatttcattgccccttttttaacaacttattaactggaaaaaccctgggtttaccaaatttaatccctttgaaaaaaatcccctt

SEQ ID NO: 79666 - DNA, 437 bp, Zea mays
  Clone ID: LIB3088-008-Q1-K1-H11
gcagaagttgcagtatcttgcatttgcaagctggcttggaattgtgctttgtttgtcctggaacttcgttgctgtcatagtctgctggatcaaggagggagattcaaagttgtttttccttgcaacaatctatgctttgcttggaattcctctgtcatattcgatatggtacaggccactctaccgtgcaatgaggactaacagtgctttcagttttggatggtttttcctgtgttacctgatccacattggtttttgcataattgctgccattgctccaccaattgtatttcatgggaaatcattaactggtattctggctgcgattgacactttctctgaacatgtgataattgggatcttttactttgtggggtttgcactgttttgtctggagacactgctgagcattggggttcttcagaaagtgtacatgt

SEQ ID NO: 79667 - DNA, 393 bp, Zea mays
  Clone ID: LIB3088-008-Q1-K1-H12
cccacgcgtgcgctgtactcgcgttggcctgcaataatcctagtgagatatgccggaacagtcactgcgggcctgacatatctagctgcgtcagtcagctctactccagtgtatgtacactgaggcatctgtaatgttcatgtgtatagcctgcagcgtgatgaaccacttactgggatctgtacagggctaggtcgactagctctgaattcatgtggatagagcggaaccggatggacctgaatcacattcatgtcaaactacttgttaacattgctcaatcccactcaatccatgtgaaatgagaataaccgaccaagccctgagagggcacgttacttcattcacgaaggattgggcacttgaagttaaaagaatcatacacatcttgtt

SEQ ID NO: 79668 - DNA, 153 bp, Zea mays
  Clone ID: LIB3088-008-Q1-K1-H3
cggacgcgtgggtttgcatcagttttgctgagccgtttttttatacgtgaggatttagagtactaacaatttaagtccaagaaaaatcaacagtgaagttcaactcagcagattaaatcttcaaagtgccgtttttaactgggagttgagctc

SEQ ID NO: 79669 - DNA, 462 bp, Zea mays
  unsure at all n locations
  Clone ID: LIB3088-008-Q1-K1-H4
tggtgataggagcagcactaacaagacaaataaagatgaagatgaagcttcagaagatgcatttactaggagaacaaggtctcccactaaggaagaagaaacaatcactaatccaactgatcgtatagtggcctatttgctgtttcatagacattgctcccaggttgcagcagcaacaaaagaagaaatcatatcctcaacccccttgacactagaacctgagctgaaggtaccattgggaactactatggtactatcagaagatcaactgctttcagaggatcaacgagatgagcaaaaaaatgcgttgcagccgtcacaataagatgctgattgatcaactgttcagaatcaatatgatagcaaaccccgtgatgatgacagtctgctgatcacctgtggctccggagatcccttgtgtaatatgtaaccatntcaacattgtagcattctttttttttt

SEQ ID NO: 79670 - DNA, 408 bp, Zea mays
  Clone ID: LIB3088-008-Q1-K1-F9
cggacgcgagggaagaggttgactgtagattatgacacccttctgctgctactagtgaagctggaagctgaagaagaagtgcctcgatcattacactttggttgactactataggacatgcagccttgaggagctatagcagtctagatactataggggctctagatatgaaactataggattattgctaataatgtcaaatgcttaataattgaacttgaaaccataagaatggctaagagtctgatgcataaggatttgagatatatggattggagatatatgaatattcgacgggtggaattcaggagaagaaaaggaacttgttttcaagaatgcactgcgttgctcggacgagagacgggacggaataaaatgcgtgtggtctgtaaaggtcccaagcttacg

SEQ ID NO: 79671 - DNA, 234 bp, Zea mays
  Clone ID: LIB3088-042-Q1-K1-A11
acgatactgacttggtcgagactataaaatcattctggatgcggagacccatagggccgcgtagagaaagcttaagagcttattctacagagacgcgatacccagccccatggacggcatgaactgtacagagctagacgggcggaacattatcgcctacgatgcccagatccgcggcttgcggagaggcagcggtggcgcatacagtggcccgcgccctgatagaggcggcta

SEQ ID NO: 79672 - DNA, 351 bp, Zea mays
  Clone ID: LIB3088-042-Q1-K1-A12
cccacgcgtccgcagcaacttcatgtctgaccctgtgcacggtgccatcgaagtctgtgctcagctgaggcccaccgttgacatctcagtgaccgctgatgcagatttcgtgcgcccagagcttcgacagtcttcataagcttgtatggatccgcagtgtgactgcaatggctagtttgtaagaacttaatatgcctgggcttttgaactcttagattgtgcttgtattgctcgtgcttgaggaccagaaaattaaactcttggcggtgtggtactgttgtgatttgcaagaataaaaataattggtttaaactaaatgtctgattcgctatgtatgcactttttgatgcg

SEQ ID NO: 79673 - DNA, 342 bp, Zea mays
  Clone ID: LIB3088-042-Q1-K1-A2
ggagtatatgccattggtgatgtggctaccttccctttgaagatgtacaatgagttgaggagagtggaacatgttgaccattctagaaagtctgcagagcaggctgtaaaggcgatcaagggcaaagagtccggtgaaccagttccggagtatgactacctgccatacttctactcccgatcattcgacctggcgtggcaattctacggcgacaacgtgggcgaaaccatcctgtttggcgacagtgaccccaccttcagcaagcccaagttcggctcgtactggatcaaggacggcaaggtcttgggcgccttcctggagggcgggtcaccggacgagaac

SEQ ID NO: 79674 - DNA, 408 bp, Zea mays
  Clone ID: LIB3088-042-Q1-K1-A3
cggacgcgtgggcggacgcgtgggatcgattcggaagtgaagaggctccaaggactctggcccctcacaccagaggagatcactctagtgcttaaagctctagggttcacaaaggacactctgatatacattgcttccggtgaaatctatggcggtgaaaggcgcctggccgtgctcaaggctgcgtaccctaaactagtaaggaaggagaagattttatctcccgatgaactgcggccgttccagaaccattcgacccagatggcagcgctggattacatggtctctctagcaagtgacactttcattcccagctacgacggaaatatggcaagggttgtcgaaagccaccgcaggtatatgggtttccgcaagaccatcgtcttggacagaaagaagctcgtcgag

SEQ ID NO: 79675 - DNA, 366 bp, Zea mays
  Clone ID: LIB3088-042-Q1-K1-A4
cccacgcgtccgcccacgcgtccgcggacgcgtgggatcagattgcaatctcggatcgtgtagatgcattctctacgttcctccggacctcagtctggtgataatctcaagatccgagaatttccggcgatttggtagcaaacgtgatgtaaagaaactaagagtgtgtttggtttgaggaatgaagtaatccatcttcttctcaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaatataatataaaaaaataaaataaatttatttaaagaagaattaaaatgaaaagttttgggggg

SEQ ID NO: 79676 - DNA, 405 bp, Zea mays
  Clone ID: LIB3088-042-Q1-K1-A5
cttttgctgaaaactggctagcgcacgagctctccggaccttggagatccccaggagcgagatcagcgattccatggtggaatccgtggcgccgcggctgccgaacgtcactttcctcgacatcagcagctgcacgaagatgggggcccgcgggctggaggcgttcggcaagcactgcaagtccctggcggggctgcggcgggtgatgcacccgatcgacctggcggacagggcgtgccagcacgacgaggcgcacgccatcgcgtgcagcatgcccaggctgcggcacctggagatggggtacatgctggtggcgacggaggcggtggcggagatcctggggcggtgccgcgagctcaggttcctggacctgcgcggctgctgggcggtggacgacaagcttct

SEQ ID NO: 79677 - DNA, 438 bp, Zea mays
  unsure at all n locations
  Clone ID: LIB3088-042-Q1-K1-A6
ctacgcgtccgcccacgcgtccgcccacgcgtccgcccacgcgtccgcggacgcgtgggaagagctcaaggaggccttccgtgtgtttgacaaggaccagaacggcttcatctcggccgccgagctccgccatgtcatgacaaatcttggtgagaagctaactgatgaggaggtggacgagatgatccgtgaggctgatgtcgatggtgatggccagatcaactacgaggagtttgtcaaggtcatgatggccaagtgagccacagaaccataatctgaaggcagagaagattatgcattgcatattagtcaagatgcaactttttattccatcgacttctagtgaaacattctgctagttgtagttgcttgaaaaagcaatgtaagtcccggcttnggtcttccttcaatgtggtttcagaactggtgtttcatgtg

SEQ ID NO: 79678 - DNA, 303 bp, Zea mays
  Clone ID: LIB3088-042-Q1-K1-A7
gcgcggacgcgtgggcgtagccgtggtgcaactctccacgtacttggtgctgtaggcgctgcagtgcgacgggcgcctttgccgggccggctggcagatcctcgtcgagtccttcaccgacttcgccatgctctcgcatacactgtggatcctgttctaccaccggctgctgctgcccaagctccgcaagataaccggtacggaggaggggttcacgctgctccagcgccagggcatcaggatcgtgctctgcactggacccatggtcatcataggcattgtctaggacacgacgccgtgcca

SEQ ID NO: 79679 - DNA, 282 bp, Zea mays
  Clone ID: LIB3088-042-Q1-K1-A9
cccacgcgtccgcccaaacaagtcaaactgtttaattcttttcaatcccatccaacccatgtgtattagtaataaccgaacaaccccttagggcttgttcggttagctctcaatccatatggatagagtgagattgggtgggattaaatcctaagcaagtcaaagttcttctaatctttttccaataaatactcaaagaacaaacaatgataggtgacaccggtggtgctgctgatagggtgttgaaaccagctgcttactgagatggatggcaaagaatgc

SEQ ID NO: 79680 - DNA, 223 bp, Zea mays
  Clone ID: LIB3088-042-Q1-K1-B1
cccacgcgtccgggtacctgttgaggtgtgtaagacagtagctagcaaccgtatgcctgggtttcctgtttgggtgcgtgacttgccgactttctagctgcttctggggttttgacctcggtaaggaaagaataaaaagataatcggagtgcaatgctaaaaaaataaaaaataaaaaaaaaaaaaacaaaaaaaactaaaaaaaaaaaaaaaaaattaaaaa

SEQ ID NO: 79681 - DNA, 385 bp, Zea mays
  Clone ID: LIB3088-042-Q1-K1-B10
gggagaatgatgcgatgatcaattcaaccatcagaattctttgttctccaacgatgaaaggttttacgcgtgagaataaacagcgcagagtggtgagcgctatataaaagcactgggcttgcactgttgttagtggttcatttgctttcttagattcggatagtacagttggtggatccatgattgatgtggatacatataccatgttgccatggcagcctgtttatcacacattcacttcaactagaacattgcggcgccctcacgggcgccctaccaaaaaaaaaaaaaaaaaaaaaaaaaaaaaaaaaaaataaaaaaaaaaaaataaataataaaaataaataaaaaatataataatttacaatttaaattatttttaatt

SEQ ID NO: 79682 - DNA, 429 bp, Zea mays
  Clone ID: LIB3088-042-Q1-K1-B11
cccacgcgtccgcggacgcgtgggtgggcattctccatttatttggaagctgtcgcgatatttccacaacttgtgttgctacagcggacaaggaatattgacaacctgactggccaatatgtcttcttcttgggtgcctaccgtgtgctttatatccttaactggatttaccgatacttcactgagccccattttgtccactggataagttggatggcaggaatagtgcaaactctgttgtatgctgacttcttcttttattacataatgagctggaagaacaatgtgaagctagagctgccagcttaaggttgctgctcctgtccccaagatatagtagggtaatatatcagataggcaggccccatacacagcatgatcattgctatcgccaactgggttatgaaaaaagcattttagttgcgtggc

SEQ ID NO: 79683 - DNA, 181 bp, Zea mays
  Clone ID: LIB3088-042-Q1-K1-B12
aaaaaaaaaaaaaaaaattaaaaaaaaaatataaaaaattataaaaaaaaaaaaaaaaaaaaagaaaaattgaaaaattaaaaaaggaaaaaaaaaaaaaaaaaaacaaaaaaaataaaaaaaggggccccctttttaaaggttccaacttttcttccccttcctttcaactctttacctt

SEQ ID NO: 79684 - DNA, 161 bp, Zea mays
  Clone ID: LIB3088-042-Q1-K1-B2
tctagttccatgtttctaacttatgttccattttgaagtcccgagtgtttcaaaaagtgctagcagctagacgtgcctagcaacctaggtggtgctcaggcgttgcttgacatttgtactttctatggacagtatgccatgttgaataaagtatttttggc

SEQ ID NO: 79685 - DNA, 260 bp, Zea mays
  Clone ID: LIB3088-042-Q1-K1-B3
gctaagtagatagaccagattaaatgacattttcctatctacaatattacggacccataggacaacttacatgcccatgtggaacaatcaacttatcacctcatataacccattatcattacacatgcacataaattcctttacatttcatttatataactcaacctgcattatattatcattggttgcacgttttctatataaattctgtgacattaccaacttacaatattgatttcatctaaaatgtaacatatttt

SEQ ID NO: 79686 - DNA, 445 bp, Zea mays
  unsure at all n locations
  Clone ID: LIB3088-042-Q1-K1-B4
cgcggtccgtcaaggccgggctgcagttccccgtcggccggatcgggcgctacctgaagaggggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgacgaggagctcgggaagctgctggcaggcgtcaccatcgcgcacggcggcgtcctccccaacatccactccgtgctcctgcccaagaaggcggcggagaaggcggccagcgccggcagcaaggagcccaagtcccccaagaagggcgccaagtcccccaagaaggcttagaaagtanggacttcatttgcactgtgtgctgtagcatgctcgtgtctagatct

SEQ ID NO: 79687 - DNA, 440 bp, Zea mays
  Clone ID: LIB3088-042-Q1-K1-A10
ctttacaagattcttatgccgatgacccgatcgggttctttttatacggagtgttttttttttttgaaacgaagtacaggttccctgatatcggtggccagcagccgactttgtggttagtccattctcttccggcgggatacgttgcggaccacttcgctcagctgctcgcgacggcggcttgtaccctgatttgggtggggaggatgcctgatatccagctgggatgccacactataaggtcccatggtaccaaagtggcaacattacacatgtatgactggattatacttttatgtcttgctgtacttgatggactgttaaacataatcgagccctttcaccgctttgttggacgcgacatgatgaccgacttgagttatcccctcaagggcaacacaatcccattttgggctgttccactgattgcgatcgtgcta

SEQ ID NO: 79688 - DNA, 276 bp, Zea mays
  Clone ID: LIB3088-042-Q1-K1-B5
gcggtacgattgatcttgtttagaacttggaataagagaatgcttcgaccctcagctggattggatggatgagcctacggtgctgcacaagccgaaccggccctgcgcccctgcctaacaccaatatgttggacacttccactactgttcttcacttcccatttgtataacgggacctgcattattgtagcatgggtgcagcgtttcctatgtaatttctgtgacattaccaactcacaatattgatttcatctgaaatgtaacatattttttcac

SEQ ID NO: 79689 - DNA, 309 bp, Zea mays
  Clone ID: LIB3088-042-Q1-K1-B6
ttccctttcgacccacgcgtgcgcggacgcttgggcttcgggcaaggtggcctttcatatctgttttcaccttgacatggttgcaaagcacggaatgtattggactgacctacgagaaatggctgctctgcgctgttggttcacatagggtctctgtatagacgcttgtccatatcaagtaacctgtttagaccaccataccaatatcaaatataggctgctcgctgtatcatgtccacggttacctacgcttgcatacgaacatatgctgcttctatactgtcgtcaacatctgtttagcatgacaca

SEQ ID NO: 79690 - DNA, 347 bp, Zea mays
  Clone ID: LIB3088-041-Q1-K1-G2
gcgcccagcgcgtccgcccacgcgtccgcccacttttccttaagaagtagatcatgcacccactggtgatgacttcgtctagtgtccctccgttcaatgtcgtcgtcgtcgtcgtgtaccttacgtgacatgctgtagcacgtacgctagcagagcagcacctcaatgtccttgggtttgctttgctggctctctgttttcgtcttgtgttgcttttaatctggcacaggtttctaaattataataatgaatacttttttgtccattaaaaaaaaacaacaaaacatctaaataaaataataaccaaaagacatcttgaaccattatcattaacaaacactacaatt

SEQ ID NO: 79691 - DNA, 279 bp, Zea mays
  unsure at all n locations
  Clone ID: LIB3088-041-Q1-K1-G3
acgttttgctgtcatcagcatgtgaaactggtttagagattggtgatcttggaaacttgtacagcnatggtcaaacaccatggtcctgttttaagcaagggggtgagagtgctgaaaaggctgcaaaggatctcgtacttattttagagacaatgaggataattgcaatcacactatctcctatcactccaagcctttctctgaggatttacacacagcttggtttcacagaagaccagtttagggtgttgagatgggaggatacgaaattgggaagcc

SEQ ID NO: 79692 - DNA, 227 bp, Zea mays
  Clone ID: LIB3088-041-Q1-K1-G4
ccaattcccaactcgacccactcgtcctaccacacatcctcatacttaaccaaaatgctctattttcctttacacattttacaacaacgatcatgtaatatcctcctactatctccacattttccactcaacatccttctaaccatccctcaacaaataatcacactacccatactaaccacaaatatacctacacaatccttattacaaacccttacttctcaaca

SEQ ID NO: 79693 - DNA, 181 bp, Zea mays
  Clone ID: LIB3088-041-Q1-K1-G5
attccaccctcaccgaccgtacccctgttctcctactcttcaaactttagctttatcctccatacccttaccaaacgcctatgtagcttcacacaacactaccacaccgcaaattctctgccactcatctcgtccaggaaaacctccactgcaccgcccatcccttagccgactactacca

SEQ ID NO: 79694 - DNA, 175 bp, Zea mays
  Clone ID: LIB3088-041-Q1-K1-G6
gcgatatgcttaacctcactaacaccaactagctactctatctctcctccaataatgggcactgtatactcctcctcccagacaaagattgtcgatacgccatctatcatttcaacttcgctactgctgatgacgtccagaacaccaacatcttctatatcctatgagctccatc

SEQ ID NO: 79695 - DNA, 362 bp, Zea mays
  Clone ID: LIB3088-041-Q1-K1-G7
acaagttcaaggagatcgttgtggaccaggtcggggatcgcgctaccagctacggggactgcacaaacagcctccccgagaatgactgccgatacgcgatctatgatttcgactttgtcactgcagaagatgtccagaagagcaggatcttctatatcctatggtccccatcctccgccaaggtgaagagcaagatgctttatgcaagctcaaaccaaaaattcaagagtgggctcaatggcattcaggtggaactgcaagctactgatgcaagtgaaatcagccttgatgagatcaaggatcgggctcgctaggcatcatgatcatgcatcatggactcggcctactactggggaattgga

SEQ ID NO: 79696 - DNA, 256 bp, Zea mays
  Clone ID: LIB3088-041-Q1-K1-G8
gcggttgtctcatgtcgatgctgtcccacattttcttccccatgtttttctggcgtggagattgtaaggttctacaaagtcacggtctccaaagtgacagcttgcttgattttaaacagtgtcgacagtgttttgtctctacacagattgcagatatagcggtttaaacagttcgctttaatccgaaacgaacaggctattttacctgaatcataaaacaaaaataaaaaaaacctctcaataaaattcaagcaaa

SEQ ID NO: 79697 - DNA, 433 bp, Zea mays
  Clone ID: LIB3088-041-Q1-K1-G9
atggggatatcatactggcggatcttgggacaccctattatggctgttcacactggtatcgataaaaatgagtagaccataattggcccagaaggcacattactgtgagccgatgagagactgacagatacacgtggccggaatactacgacactcgatctgggaggttcattgggaagcaatcccgatcttatcagacatggactattgctggatttctgacctcaaaaatgttgctggagaacccacagctggcttctattctgacctgtgatgatgaccttgagctgctcgaaggctgtgcttgctgcctgtccaagaagacgacaaagtgctcacggcgagcggcctagtcacatgctgcgtgaaactgcgaagcttatgttggcttttatactgatgatgcacaatgtgtactaccaacggaaaatta

SEQ ID NO: 79698 - DNA, 409 bp, Zea mays
  Clone ID: LIB3088-041-Q1-K1-H1
gcggtttgtgaggaaagcgacaagctgaagatatagtttttgcagtcaggtggcgtacaattggcgcacggtgtttttcttctatagacaaaaggggagaaatgacacctcccccctcgagaattggggaacaaggacagatctgacacctcaattgcgagaaataaaaataacagccgacagttgcatgatccctgaacgaataaattcagaactagaaaacagatgtcagtaaacaacatgtggtgaatgttggaacttgaactgctctagttcagtgggcatctgttgttgcatgcttgggatggatttaatgtttcgttttttttcttccttgtactgaagtgctctgatcggtaacgatcactgtgtgtgaaatgcttgattgttatgtggtatcatgagaatg

SEQ ID NO: 79699 - DNA, 95 bp, Zea mays
  Clone ID: LIB3088-041-Q1-K1-H10
aaaagaaaaaaaaaaaaaacaaaataaaaaattaaaaaaaaaaaaaaccaacaatgttaagagtccaattttaaaaacccgtggatgcaaactaa

SEQ ID NO: 79700 - DNA, 440 bp, Zea mays
  unsure at all n locations
  Clone ID: LIB3088-041-Q1-K1-H11
cgcgctcctgatccttatctctgcgcgcgctgcatcggcgcccgccgggaggcggatccggcccgcctcgtccatgttgtgggtccgcaatatccgccgcttcgtcgacacgggcgccggcctcggatccgaggccatcatggaactggagactaaaaggatattgcttgagattttcaaggagcggcagcggaagagtgccgaggctggttccatcccaagtttttacaagaaacctgaagaaggatccattagctctagagttcaaaggttggccaagtacaggtttctaaagaaacaatcagagcttctgctgaatgctgatgatcttgatgccatgtgggtttgtctcagagaaaattgtgttattgatgatgctactggtgctgaaaaggtaagattcctttntgatgtattttacaccacatcagctagttttg

SEQ ID NO: 79701 - DNA, 232 bp, Zea mays
  Clone ID: LIB3088-041-Q1-K1-H2
gggaagtttgctgtgaagaggaaagcggttgggatttggggatgcaaggactgtgggaaggtcaaggccggtggtgcttacaccatgaacactgctagtgcggtcactgtcaggagcacgatccgtcgcttgagggagcagactgaagcatgatcggtcgcttgtcaggcatactggggtccactatattggctgtgtagccgagacagtactccaaccttctagatcgcga

SEQ ID NO: 79702 - DNA, 341 bp, Zea mays
  unsure at all n locations
  Clone ID: LIB3088-041-Q1-K1-H3
aattcccgggntcgactcgcacgcgtgccgcagaagacccagaggagaaccaacccagatgccgatgtcccaagtgaccntgtcagtcccatttatttcctatgggacttcgggattgtacccaatttnntagaagtcttacnntcgaatttctgtaagggcctaaagaatnccaatcagaaatgtgtttatttgggttttaggtcccagaattatttagtgcannatctgatgcccgtttgaatttnnctgttttccttttttaaccacccatgtacccaatangaaccattttcgggacccagtcattatnnngttcctngtatttctctttttcggtg

SEQ ID NO: 79703 - DNA, 410 bp, Zea mays
  Clone ID: LIB3088-041-Q1-K1-H4
acgacagtgtggaagtgccacacgcggcttctgtaaaggaacctgatgctgttgctcagggaaatggtaccgttcagaaacagagcatttctactgaaagccagggcaatgcacaaggcaagcaacagagaaggtgcaaggagtgtgatgtactcgtggaggacaagctatacagagagcactgcaagagtgggtggcacaaacacaactacacacgccacaagaatgggctcccgcctctcagccaagaggagtgtatggtggagatggaattggccgacttcaagaaagaccttaaagactacgatttctgatgaagatggttaacaaggggtgcacagggcatgaaattgttgccagtccctttttattttaaataggaagttaagaatgaggcacatggtcgtttc

SEQ ID NO: 79704 - DNA, 443 bp, Zea mays
  Clone ID: LIB3088-041-Q1-K1-H5
acgcgcgcaccaatcgcccacaagcgctcgcattagaggtcgaaaccctagcttttggggcgtgtgcggtttagagaagatgatctacgacgtgaactcccccctcttccgttccttcctcagccagaagggcggcgccgacaagaggaaaatggaggagcataaaccaaaggagcagaggcccaaggccaacgagaacaagcctgtgatgaacgaatgagtatctccagaagctttgttcaatgtgcaaccaagtccgatgtccgtttgctctggttagcttaaaaccaacgcttccaataatcctattggtgtcttagtttccccttatagtgttatttgctcggcttgaacattgcaaacggaaatgaaacttgaactacctatggtactgtcatcaatttgagacccccatgattgacaaaaaaaaaaaaaaagggccg

SEQ ID NO: 79705 - DNA, 191 bp, Zea mays
  Clone ID: LIB3088-041-Q1-K1-H6
acgataggcttaaccacactaacacctactatttactctatctctctaccaatatacgggcacagtataatcatccttccagacaattactgtctatactccatctatcatttcaactttgctactgctgatgacatccagaacaccaacatcttctatatcctatgatctccatccatcctgacatctta

SEQ ID NO: 79706 - DNA, 424 bp, Zea mays
  unsure at all n locations
  Clone ID: LIB3088-041-Q1-K1-H7
cccacgcgtccgcggacgcgtgggaaactccaagaaattgttctacaaaagaatggagagtgaggaaggagaaagccttgatggtgaactctctagtaaaatcatacataaatgtggcggcataccattggctatcattgctatagctagtttgttggttgaaagatcacgtgaggagtggtcagaagtgtacgacaagattggtcttgggaatgaagacaatacagcaaagataatgtcatacagctactatgatctgcctncttatctcaagccatgtctactgcaactaagcatgtatccagaagactatctctttgacacaaaagttgcgatatggatgtggataggtgaaggtctagtccatcttgagaaagaggagggtagcctatttgagggtggagaaagatacttcaaggagctt

SEQ ID NO: 79707 - DNA, 103 bp, Zea mays
  Clone ID: LIB3088-041-Q1-K1-H8
taaaaaaaaaaaaaaaaaaaaaaaaaaaaattaaaaaaaaaaaaaaaaaaaaaacaggtataggagaccttaaaaaacatacacatccatacaacaatataaa

SEQ ID NO: 79708 - DNA, 390 bp, Zea mays
  Clone ID: LIB3088-041-Q1-K1-H9
cccacgcgtcctgctgaacagtgcaacacttagatttgtatttaaccaactgaaatgtttgattccacttataaacgtttaaatcatataatgttgtttatataaaaaaaaaaaaaaaaaaacaaaaaaacaaaattataataaaactaaaaaataaaaaaaaaaaaaataaaaaaaataaaaaaaaaaaaaaaaaaaaaataccaaaaaaaaaaaacatacaaaaaaaaaacgggagaccctttaaaaggatccattttctctacaccttaatatgaaatcaaaacatttttttaggaaccaaattaaattatgtgaatgctttaaaacttgatgccatgtaaaaacctttgatataccaatttaatacccattatactaattcccctt

SEQ ID NO: 79709 - DNA, 313 bp, Zea mays
  Clone ID: LIB3088-042-Q1-K1-A1
cacacgcgttcgaggacgcgttggttatttttttgagattttcattactgggttaactgagagatcaaagatgtggctaaccacataaggtgtacaaaatgatgctttgaatttagctacataccacaaagataaacctacatgcctgtacaaacattaaatgcccttgcggacagctccggcagcatggagcccaagtgccccaagaagggccccaagttccccaagaaggcttacaaagtggggacttcatttgcactgagtgctgtcacatgctcgtgtctagatatgtggatcatatgtgttctgatct

SEQ ID NO: 79710 - DNA, 204 bp, Zea mays
  Clone ID: LIB3088-041-Q1-K1-G12
tttcacccacgcgtcctcccactttttcgaaaaaaaaaaaaaaaaagagaaaaaacaaaaataaaaaaaaaaaaaaaaaaaaaaaaaaaaaaaaaaaaaaaaaaaacaataaaaaaaaaaaaaactaataaaaaaaaacaaaaaaaaataacacaacaccaaaaacacacaaatataacaaaattccaccgtatacaacacaca

SEQ ID NO: 79711 - DNA, 329 bp, Zea mays
  Clone ID: LIB3088-041-Q1-K1-D8
cgtgggttctcctccttcttccgtgtagctctcggtttcagcgatgtcggagactgatgcaattgtcaacaaggcggctgcgcaagcggcggcgccaagcgccaccgcaaggtgctgcgcgacaacatccagggcatcacgaagccggcgatccgtaggctggccaggatgggcggcgtcaagcgcatttctgggctcatctacgaagagacccgcggcgtgctcaagatcttcctccagaacgtcatccgcgacgccgtcacctacacccaacacgcccgccccaagaaccgtacccgcatggatgtcgtctacccccttaaacccca

SEQ ID NO: 79712 - DNA, 342 bp, Zea mays
  Clone ID: LIB3088-041-Q1-K1-E1
agccttcctggtagctagacttttacctatgctgagaacatcatctggtacgactctgttcatttcaatggttcacgacccatgactgaagctgctcaaagctccattctggatggtgtacatcattacgagctccaatgttgatgtcagtggcctctctttctcgatcttctccatttttactttaccttatctttcttttttaatgaaccacttcttgtgctcctgatttccttttttttttctttgccattactctttttattccattgttagttatggtctcctaaatttaatcgatcttacaaactttctcttttcttttaaaataattttaaataa

SEQ ID NO: 79713 - DNA, 313 bp, Zea mays
  Clone ID: LIB3088-041-Q1-K1-E10
acgcccaggcgtccgcccacgcgtccgttccgtttaagacgtgttttgatgtgaacgatcagtagtgtgcttacaaacaagtgatgccctattcttctttcacttcttgccgcttttccaatggttaaaacattcccttctaataattcttacaccttttttttttctttctttgaaaagaacctaataattcttaaattgacccaattgtttgaattgtaacacgcacaaaccaaggttcgtcttttctacttttgtataagattgtgcctctaataaaatggtctaaaccccttactaagggatctgcttg

SEQ ID NO: 79714 - DNA, 436 bp, Zea mays
  unsure at all n locations
  Clone ID: LIB3088-041-Q1-K1-E12
ggagtccgatccatccaagccaatccaatttagagaagaagaagaagaggaggaggaagagtncatcttagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacccaataatcattataataaccagttcagaaattgattcccaat

SEQ ID NO: 79715 - DNA, 273 bp, Zea mays
  unsure at all n locations
  Clone ID: LIB3088-041-Q1-K1-E4
tcaaactatctatttttagtactagcantgtcgtttcnttttcagctntgtttaaattgtattaagacatgcccttnaccatcaccantatctttccntttgaatcanttntaatgcattcatcntcattcttggctcttcctgatctatctttcattaactatctatattatatcattatcaatgttattcaattattctttttcaaaaaaaaaaaaaaaaatctgcctctctatattatccaaccttacttacgccttcattccacttcat

SEQ ID NO: 79716 - DNA, 272 bp, Zea mays
  Clone ID: LIB3088-041-Q1-K1-E5
gtctacacacatacccaagaacatcctttagattatccataccataactaacaccatggatatgttctacactaacatttacacttccattaccattcttatctctgttctcacctcttacaattctatcttcattgtcataattattttcgttccaccttttgctctacctttatctctttactaatccttttcactttcctcaacacttaacataatatttcctacaatcttcactcataacataaattaactaaaaaatttacataaaa

SEQ ID NO: 79717 - DNA, 304 bp, Zea mays
  unsure at all n locations
  Clone ID: LIB3088-041-Q1-K1-E6
gcgcccgcgcgtccgggggcgacgaaaatggcttcaacgaccgccaccaaggacgacggtntagtcggctacgagcgccggcgcgagctgcaggcgttcgacgacacgaagctgggggtgaaaggcctggtggactccggcgtcaagtccatcccgtccatcttccaccacccgccggaagccctgagcgacataatttctccggcgccgcctctgccgccgtcgtcgccctccggcgccgccatcccggtggtggacctctcggtgacgcggcgcgaggacctagtccagcaagtgaagcacg

SEQ ID NO: 79718 - DNA, 353 bp, Zea mays
  Clone ID: LIB3088-041-Q1-K1-F10
cccacgcgtccgaaaaaaaaaaataaaaaataaaaaaaaaaaaaaaaaaaaaaaagaaaaagaaaaaaataaaaaaaaaaaaagaaaaaaaaaaaaaaaaaaaaaaaaaaaaaaaaaaaaaaaaaaaaaaaaaaaaaaaaggccccccctttaaaaaaaccaaattttacttccccatcattccaacataaaacctcttataaagaccccccaaaattaaattaatttccctttttttaaaaaccactaaattgaaaaaaccttgcttttcccaaacttaatcccttttaaaaaaatccccttttcacaaattgactaaataacaaaaagacccaatccaaaaccctttccaa

SEQ ID NO: 79719 - DNA, 253 bp, Zea mays
  Clone ID: LIB3088-041-Q1-K1-F11
acgcccaggcgtccgcccacgcgtccttccacttgtccgcccacgcgtcctccgtcctgtaacgaattcttatgtagtagggctttcctgctttgttaaagaataaacaatgaggtttcagttttggtggcgcaaaaaaaaaaaactaaaaaaaaataataaaaaaaaaaaccaaaaaaaagcaaaacttaccatatattaaaaaaaaaaactaaaaaatttaaaaaaaaaaacggggcgccgttttaaataa

SEQ ID NO: 79720 - DNA, 410 bp, Zea mays
  Clone ID: LIB3088-041-Q1-K1-F12
aacagagcttcgggatagatatcatggaatatggccacttgtcatactacacaggaagctgatttccaagcttatggaaaagtcgtctaataggcatttgattgagacctggagaacaaatggggctttgtatacttcaccaagtgggtcaaatgatgactggtattggctatatgcagcgatcaaactaaattgtttgcttgtgactaatgatgaaatgagagatcacatattcgagcttctagggccgtctttttttccaaagtggaagcaacgccatcgggtaaagtacacctttaataaaggaaaaacggtgcttgtgatgccacccccttactcttcagaacttcaagagtcggaaatgggatcttggcacattccaattgaagagaagtctgggaatgagagag

SEQ ID NO: 79721 - DNA, 366 bp, Zea mays
  Clone ID: LIB3088-041-Q1-K1-F4
atgatctgtgcgctttatcgacaggcacataaacattcctgtgctgtgcttggacgaatggtctcggggcttgttgtttgactctactattatttattctttgtgcttctgactgcctaagtattattaacattattggtttgggaaagttaacaaggcccggttggccagtcgctgtagaagcttggggagaggaggggggtgtcaatgtgacggacaataataaggtttcgttggtgtaccagagatagttgtaatatgtcatgtgctgatgcttttgtgtggtgctagtacaagacaaccagacagctatagttgaggcaatgattattttgcgttcataaaaaaaatattaattatattttt

SEQ ID NO: 79722 - DNA, 432 bp, Zea mays
  unsure at all n locations
  Clone ID: LIB3088-041-Q1-K1-F5
cgaatcgtctcgctcgtggctgccctgctcatactgcttgccctcgccgtatcggccaccgtcaacgcacaggaggattccatggccgacaacaccgggacgttggcgggcggcatcaaggacgtgccggggaacgagaacgaccttcacctccaggagctcgcccgattcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacttcaaggagctgcaagaattcaagcctgttgaagagggtgctagcgcctaaggatctctccttctncatgtgcgagcctgaagctcaaag

SEQ ID NO: 79723 - DNA, 359 bp, Zea mays
  Clone ID: LIB3088-041-Q1-K1-F6
agcagcaagagaactcgggaaaagtagaatttacatgggtgtaccttttatagcgtaattgtttagagacaaaggacaccacattaaatcacaggttaatgctgcttcaggtgctatttctctaatacaacttcaagaagggatgaaaaagatggaggggagtgaggacagcgaggagcaacttatgaagagttttgaggagaaaaaagatgccatgctcagctcgctttggaaaatcaatgtggttgatatcgagtccacgctctcacgtgtctgccaagcagttctgagagatagcatggtctccaaagatgtcctgaagctgcgagccaaaagcgttaaaaagctcggaacgatat

SEQ ID NO: 79724 - DNA, 404 bp, Zea mays
  unsure at all n locations
  Clone ID: LIB3088-041-Q1-K1-F8
gcgaacgaatgcaattatatcggctgcttgtgttttggaagccttaaagcttatttggggntgcagcaaaagtgtgtcaaactatctcacgtacaacggtctggaaggaacacacattaaagtaactgagtttgtcagagacaaagattgccttgtatgtgggcctggtacccttgttgagctggatacgtcatctactctttcagatgaagatgactggcgcatcgttagacttagtactcgtcaacatcttcgttcatcaagatgcttgaagagcaccccaagttgcggatgtcgaaagccagcgtgacgcacgaaggtaacaacctgtacatgcagtcaccggaggtgctggagcagatgacacggccaaacctgagcatccccatgtttgacctttttaa

SEQ ID NO: 79725 - DNA, 420 bp, Zea mays
  Clone ID: LIB3088-041-Q1-K1-F9
aatccccgggccgaccgacgtttacggaacaagttccaatattataacctttaagcattcaagacaacagtcacagcagcaggcattgtttcaaattagaaggcacgaggccatggctaggaaagcagctggtgaggagccactaccagaagaagatccatccaatcctatatttaagcctattcctgagccctcacgattggagggctatctagtaactaatcagatctgcagttactgcaaccatatcaacggggttgctggtcagaatttcgacaggctatacctgatgaaggccttgcatgatgattagaagactgggctgcgatgaatgctgttagaataagcttgtgatactgctcaaaatcgtaaattttgtgatgtacctttacatgggcctgcctgttcttctacttaatg

SEQ ID NO: 79726 - DNA, 377 bp, Zea mays
  unsure at all n locations
  Clone ID: LIB3088-041-Q1-K1-G1
gcgcccacgcgtccgcctcctactgctcggagctccagttcctgggcaacccggtgaccaaccgcgtccgtagcgcggagcagcacaaccaggacgtgaactccctgggcctcatctcgtccaggaagaccgccgaggcagtggacatcctgaagctgatgacgtccacgttcctgatcgcgctgtgccaggccatcgacctgcggcacctcgaggagaacgtgaaggccgcggtgaagaactgcgtgacgcangtggccaagaagtcgctgagcctgaacgcccggggcgggctccacaacgcgcgcttctgcgagaaggacctgcagacggcgatcgaccgcgaggccgtgttcgcgtacgcggacgacccgtgc

SEQ ID NO: 79727 - DNA, 374 bp, Zea mays
  Clone ID: LIB3088-041-Q1-K1-G10
gcgggtatctcagcttgctgcgctgcactaccctgccctgccatcatatcgtacgtgagcgcggccgagcgagagcgagggagaggcatggctgctccgaagctcgcgacgctggcgctggccgtgctcctggcggcgaccgtggtggctcccccggccgcggtgcgcgcggcgatgtcgtgttccaccgtgtacagcacgctgatgccgtgcctgccgttcgtccagatgggcggggccatgccgccccagccgtgctgcggcggcatccgcagcctgctgcagcaggccaacaacacccccgaccggcgcaccatctgcggctgcctcaagaacgtcgccaacggcgccaacgggagcggcacctacatcag

SEQ ID NO: 79728 - DNA, 438 bp, Zea mays
  Clone ID: LIB3088-041-Q1-K1-G11
caagtgaccgcgacctgcagaacacgaagctccgtgaagcctgccgtcccgacgatgaaagccggacatggcaagtcagacttcctgaggaagtctgacgatatccctacggcaaagatgctgacgagaaaattggtcagctaaacaagggtacgtagagtgaaaatccgatcatctgcaggagggtggagggatatggcgtatagtgtgcaggaaccagtgtgcccaagagaggctagctcatcctgagcgtttgcctgtcgatggtctctcggatttgccatcgccacagttttgctgcatcgagtcatcttacgaatggctttgcaaactcctttgtggagtgctagagcctgcttcgagccttaaccctcttgctggccttcgatctgccttttgcctgcgtcaactctgcccccatgtttcaataaacatgat

SEQ ID NO: 79729 - DNA, 382 bp, Zea mays
  Clone ID: LIB3088-043-Q1-K1-C4
cggacgcgtgggaccgattgctgcggagcatgaagatttgaatgcttgttggcaatgaagacgcccttgtcagaaaaccagctgccgcgagagcaacgtcaggtggagatgatgacatccttgatgatctcgacgagatgatatttggcaagaaaggaggtagcagctcccaggatccgaaaaagccagatccgaagaaggatgacctgatcagcttttaattacctttccataatcgcaaccagtacttgctattttcctggtgctgtacccactcggtagattgaagattcttattcgcatacgattcataccggtttgttcagttaagtcgctacactttggcaatcttgtttcatggctgggtcccatgaccatgaat

SEQ ID NO: 79730 - DNA, 337 bp, Zea mays
  unsure at all n locations
  Clone ID: LIB3088-043-Q1-K1-C6
gtatgtgctccccaagcaccttgatgagaaggttgctgctcttcacttgggcaagcttggggccgagctgaccaagctcaccaagtctcaagccgactacatcagcgtgccgatcgagggtccctacaagcctgcccactaccggtactaagcacacggcttgcagctcactcgggcccgtgtgtgctatgaagttcgctacactggcctgtcagttatcttttgcatgcatatgcattatcatatacgcagtcgcgtagcaggttttcttatggttatcgcttgagctgangggggagggaaagagcttgttgcttttgctgaagaataatggtgt

SEQ ID NO: 79731 - DNA, 219 bp, Zea mays
  Clone ID: LIB3088-043-Q1-K1-C7
cggacgcgtgggtccaggcctggctttgctggtttgttgtgccatcagcggtttgcttgcgcttgtagtattgtggccttcccccttttttcccttaaatgctacagttattcaggaagtggtgtagtccgtgtactgtcgcaagtctagcagagattgcagagttttgttgaaccgttgtgctgttgtatttatgcgagataactgataaccgaaggt

SEQ ID NO: 79732 - DNA, 429 bp, Zea mays
  Clone ID: LIB3088-043-Q1-K1-C8
tggggccttcggacagcccatttgcaggtggggtattcttggtgaacattcacttgccagcggattaccctttcaagccaccaaaggtgtctttccgcaccaaggtattccacccgaacatcaacagcaacggcagcatttgccttgacattcttaaggaacagtggagtcctgctttaactatctcaaaggttctcctgtcaatctgctcactgctcacggacccaaaccctgatgatcctcttgtccctgagattgctcacatgtacaagaccgacagggccaagtatgagtccaccgcacgctcctggacacagaagtatgccatgggctagaagcaaggctaaaagctggccaaactggtgaatgtgccggaccccaaatcgttatcacctaaataaccagtcaagtcgcaagtatgaatggact

SEQ ID NO: 79733 - DNA, 127 bp, Zea mays
  Clone ID: LIB3088-043-Q1-K1-C9
aaaaaaaatataaaacaaaaaaaaatataaaaaaaaaaaaaaaaaaaaaaaaaaaaagcaagcgtaaaaacaaaaacaataccacatccaaccacttttataaaccaacctataatcccattctaat

SEQ ID NO: 79734 - DNA, 415 bp, Zea mays
  unsure at all n locations
  Clone ID: LIB3088-043-Q1-K1-D1
cgtgtctgtctgcatctgcgcaggagaagaaccacgggtcgttcgacttcgtcttcgtggacgccgacaaggacaactacctcaactaccacgagcggctgctgaagctggtgaagctgggcggcctcatcggctacgacaacacgctgtggaacggctccgtcgtgctccccgacgacgcgcccatgcgcaagtacatccgcttctaccgcgacttcgtgctcgtcctcaacaaggcgctcgccgccgacgaccgcgtcgagatctgccagctccccgtcggcgacggcgtcaccctctgccgccgcgtcaagtgaaaacatgccctggcctggcctgccccaccaccgncaccgacggcgccgncggccgcatnctcattccaatcataatagacgacccgcagcattaatta

SEQ ID NO: 79735 - DNA, 423 bp, Zea mays
  unsure at all n locations
  Clone ID: LIB3088-043-Q1-K1-D10
cccacgcgtccgacaagtggaggtccaaaagcgcgtgcagatcagaatggaagcgtttcagaagtacatcgacagtatcctggagagcgcgtgcaagatggtcaccgaacagttcgcttcaagtggcttcagcatctctgaccctgatctcccggagatatcccctggaggggtggtcatgtgtggcggccccacggacacgttgagctcgtcggtgttcaaccagctttccgtcagctccatcggctcgcacagtccaggaggcaaaccttccccttccccatcaggcatggaatgtccgccgctgctcctccacaagtcgcatgagctcaagcggaggtcctcttgaactgacaaatcggcgaagcgcggtgatggctgtctttgctagtgatgtcngatatgatggcggtgacaagggaa

SEQ ID NO: 79736 - DNA, 332 bp, Zea mays
  Clone ID: LIB3088-043-Q1-K1-D11
gccaccagcgctcgtcacctccaatcaacaaattcccaatccgccgcttcccatcccgcgtgcgccgctccatttgatcgaattcccgatggcgcccaaggccgagaagaagcccgcggagaagaagccgacggaggagaaggccgagaagaagcccagggcggagaagcgcgtgccgggcaaggagggcggcgagaagaaggggaagaagaaggccaagaagagcgtcgagacgtacaagatctacatcttcaaggtgctcaagcaggtgcacccggacattggtatctcgtccaaggccatgtccatcatgaactccttcatcaacgaca

SEQ ID NO: 79737 - DNA, 459 bp, Zea mays
  Clone ID: LIB3088-043-Q1-K1-D12
gaacttggaaccaaagatcggtactacataattgatatcaactacttcccaggttgcggggaaatgccaggatatgagcgcatgttcacagacttcttactaagtctcgcacaaagcaagtacaaaaggtacttaagcgggacatgaggtgcaaggaagtttgtgaagaccatgctactgacgagatggcatataacggtggcaggtatgcttccccaccgcgccaatgtacatttgctggagacataagcataagcgggaggcttgaggaagttggcaagtctcagtgtgtgtgttcaaaatcggtggcacatgctggactggagtaggaaataaccaaagaaacgcttggatgcgctgtactcatgttgtaaaatgtttaactgaatgaacaccttcctcgtgatggctccctccatcgtaatttggcaaccatgagaattaattcttgagctttgt

SEQ ID NO: 79738 - DNA, 295 bp, Zea mays
  unsure at all n locations
  Clone ID: LIB3088-043-Q1-K1-D6
naaaaaaaaaaaaaaaaaaaaaaaaaaaattttattttaaaaaaaaaaaaaaaaaaatataggaaggggtttttttaatattttaaaaaatccaaatttaataattcttaaaataaaaaaaaaaaaaaggccgcccgttcaaaagaatccaaattaacttccccttcctttcaacctaataacctttttataaccccccctaaatcaaattcactgccccttttttaacaactccttaactgaaaaaaccctgcctttaccaaactaaatccctttgcaccaaatccccttttcc

SEQ ID NO: 79739 - DNA, 404 bp, Zea mays
  Clone ID: LIB3088-043-Q1-K1-D7
cccacgcgtccgcagcaatccctagcagaagccttccatcctcactcgctcgatggcccgcacgaagcagacggcgaggaagtccaccggcggcaaggcgccgaggaagcagttggcgactaaggcggcccgcaagtctgcccctgcgaccggcggagttaagaagccccaccgcttccgccccggtaccgtcgcgctccgggagatccgcaagtaccagaagagcacggagctgctgatccgcaagctgccgttccagcgcctggtgcgggagatcgcgcaggacttcaagaccgacctacgcttccagagctccgctgtctccgcgctgcaggaggcggctgaggcctaccttgtcggtctcttcgaggacaccaacctctgcgccatccacgccaagcgcg

SEQ ID NO: 79740 - DNA, 178 bp, Zea mays
  Clone ID: LIB3088-043-Q1-K1-D8
aaaaaaaaaaaaaaaaaaaaaaatttaaatttttcaaacaatataaaaaaaaccaggaaaaggtacaattaaatactaacaaataacccctcctatagttttacataaattcaaatttactgcccctttcttttccaccttttatttcttttaaaatccctccctaaatccaacttaa

SEQ ID NO: 79741 - DNA, 101 bp, Zea mays
  Clone ID: LIB3088-043-Q1-K1-D9
ttttgctttagtaaaactaagtaacatcaactgtgagccaacttcaagtactatgagtgaggatcactccaactatgatagtagtgtatagctacacattt

SEQ ID NO: 79742 - DNA, 206 bp, Zea mays
  unsure at all n locations
  Clone ID: LIB3088-043-Q1-K1-E1
gcgaaggggcgaccctcccttccttcgcttccttccccgcgccgcctcccggccccgtcgccgccatgggtgaagtannctcgcaggaaagccgggcaacccttaccaagtcggctaagggcccatgggcagggatcntgagggtcccacttcaaagaacacaaagggagaccagcctttgcgccttcgcaaggttggtctttgac

SEQ ID NO: 79743 - DNA, 241 bp, Zea mays
  Clone ID: LIB3088-043-Q1-K1-E10
cccacgcgtccggatagctgaggctagtggcgatggaggactgtgttattactactatagactggtggttgtgtttctgtaactggtgaatgatcaagttggaagcttttagtctatcttagatatatcagtggatagtgttttttgtattttcgttttcttttccaatgtgtgttgggtcttgtggattatcctttttttctaatctaatacaatgaagaggcatgtcttttgaagcttc

SEQ ID NO: 79744 - DNA, 255 bp, Zea mays
  Clone ID: LIB3088-043-Q1-K1-E11
cggacgcctgggcagacgcgtgggctgactctttggcggactcgtggatttttagttgcgtttttaaaaaaaaaaaaaaaaactaaaaaaaaaaaaaaataaaaaaataaaaataatatataaaaaaataaaaaaaaataaaaaaaataaaaaaatacaaaaaataaaaaaaaaatatattaaaaactaaaaaattatactttttaaataaatataatacagtgacacccctttaaaaaaataaaattttaaata

SEQ ID NO: 79745 - DNA, 397 bp, Zea mays
  Clone ID: LIB3088-043-Q1-K1-E12
gccttgaagaacaagagggtgcttatggagagtctccacaagagcaaggctgagaaggccggagagaagacactttctgacccgcttgaggcccagcgcgccgagagcaacgcgagccgcgagaggaagatcgctaggagggacgataggttggcccagagtccacgagaaataacaccacctgtctcatccacagcttcagctactggtgcacctactaaagcaccgaagtgaagtattgaaataaagctgtagctttctagtccagtactgcactctcttctataagctctagtctaatcttggagcgcctgaactagcttgctgacatataacttagtgtattgataaatgcgactatcacatctggattattctgctggattttctggtggat

SEQ ID NO: 79746 - DNA, 350 bp, Zea mays
  Clone ID: LIB3088-043-Q1-K1-C2
cccacgcgtccgagctcgcgcgctacaacaagaagcccaccatcacctcccgcgagatccagacctccgtgcgcctcgtgctccccggcgagctcgccaagcacgccgtctctgagggcaccaaggccgtcaccaagttcacctcctcctaggcttgcacgctcgccctttgtaggcttctcttgtgttgatgttcgccttgtgttgtagttagatgttgctggtttctctgtcggcgctgctctgcttctgtaggaactgcgtcatgtaacccagcaaggacttgtttatttgtgaatcatcaacactttgttgttgatcacttatgttccaaattctgagtttgacgc

SEQ ID NO: 79747 - DNA, 299 bp, Zea mays
  unsure at all n locations
  Clone ID: LIB3088-043-Q1-K1-E2
cccgcctcgctctctagctctcctcgctcatcgctagtgccgttcgtcgccggagtttgccgctcgtcgccggagcccgtggagttcgccggagctacgccatccgccgtccgtagtcaagcccctgctcttctccatccggtcgaaacccgtcgatccatccccgtcacacgcacggacccaaggttgaagacgacccaattattttgtgtattttataaaatactttttgatgcaattcatgagttgtatattttgtttgttgtaatatgaacacgtgtgattcgcaattcnnaana

SEQ ID NO: 79748 - DNA, 395 bp, Zea mays
  Clone ID: LIB3088-043-Q1-K1-A8
cccacgcgtccggggcaagttaaagtggttgtgaaaatagaaagcgaggaagacatgctagttttacaagggagagcaaagtctttaaatctgccaactcacataaccatagacgctggaagaacacagattgctccaaattcaaggacagtcatggctattctggggccagctgatatggttgatgatgttactggcggtctgaagcttttgtagaaaaccaccttgtcagcattttcaacttgggtcttcatagagcagtgctgggactttgcaggccacagtggtctctgcacttgtactgatgtgcggcagaagaatgaaccttggccccgttggttgacctgagtttcttgtccatgaatttatttggaaggagagcttgcattcttttt

SEQ ID NO: 79749 - DNA, 157 bp, Zea mays
  unsure at all n locations
  Clone ID: LIB3088-043-Q1-K1-A9
atggttngactgctgtcttcatccactgtttcttactgctcttaattatatnngggntccatnttttgtactcaacgaactatacaatacattccagcattcacctgatttggagaagctcactttgggccgntgcaagttctcaaaagatcccaag

SEQ ID NO: 79750 - DNA, 340 bp, Zea mays
  Clone ID: LIB3088-043-Q1-K1-B1
gcgaccggcatggagaaggtcacggtggccgagcccgaccacaaggaggagggacacgaggccgccgagaagaaggacagccttctcgccaagctgcaccgcaccagctccagttccagctcgtcgagcgacgacgaggaagaggaggtgatcggtaggaacgacaagaagatgaagaactagctgaaaagaggatgaagaactagctcagcatgcggtatcgagttgttataacggttctctttttgtttgttcgtttttttagggaaacaaaaacatttattactgtagtatcagaaaccgtaagagtaataaatttgccaggattttttcttcttaa

SEQ ID NO: 79751 - DNA, 295 bp, Zea mays
  Clone ID: LIB3088-043-Q1-K1-B10
cttattcgtcggatctgtcaacattacctgtaaactctcgattactggctgaagggtgcgatgtgctccatcgaatcctaccgctgcaaagactgattctgtggaccgtagtagatcatacataggaattcaacagctagtatgttggtgtgggatctatatgaggtatcaaaccttaactacaccctctacaaatcaatatttcttgattttagcatcataaaatgaatgtatttgccgtatttatacaccgacgtgactttgaaaaacatgtatgtacacaatttaaatgatt

SEQ ID NO: 79752 - DNA, 410 bp, Zea mays
  Clone ID: LIB3088-043-Q1-K1-B11
cccacgcgtccgcccacgcgtccgcccacgcgtccgcccacgcgtccggttcttcgatgatgacagtgcccaagttcgttccacgccttacaaaagaagaaactcgggtgtttgaatctgccagagaatcgatgactggtttcaagaaatggcgagcaggtgggatgagactgcaaaaggcttccattcttggccggaagaggaagacaaagctgcctgaatgagttttaaggtgatgtgcgctgctttgatttgctagcaccgtgagcaaagagaaaagtgaatggcagattaaatctggatgtactatgatctgctgtacattgtgcacttgtgtacagcagctctgatcaagccgtcctttgtaggaaaatgaacaccgtcttaaatcatgatatcatgtttggagc

SEQ ID NO: 79753 - DNA, 361 bp, Zea mays
  Clone ID: LIB3088-043-Q1-K1-B2
ctcaagacgtattggtctattgacgctgcaaaggaaactggccgatgccatcagatccgggtcattatcagccgatgacatcgtagcgaatgcccaacgtggacctgccccagcaaatgttcctgctcccatctacgatgaactgtgattcgtttgtcctctgtattgttaaggttagttttgcatgtggctattgggattttgtccagtgtgtggtggtcatgtaccgatctgcgattcattaaaataatttcaaatgaaaaatagttaactaacaaaaaaaacagaaaaatcaaaaaccgaaagaaaaataaatttgccagagattatttctttcttaaagaaagaataaaaaaaatga

SEQ ID NO: 79754 - DNA, 403 bp, Zea mays
  Clone ID: LIB3088-043-Q1-K1-B3
cccacgcgtccgcgcctgggccacggacgaccactccctccacaacgccttcagcacctagggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctaccgcggtggcggcggctaccgtggtggcggcggctgctacagtggtggtggcggcggctaccgccgtggcaaccgtggc

SEQ ID NO: 79755 - DNA, 355 bp, Zea mays
  Clone ID: LIB3088-043-Q1-K1-B4
acgggcctgctgagcgttccatggagcaggagcagagggttgaacttgcgaacgaccgcgacgcgcagttgtgctgcgttggggaggtggaaagcgggcgcaggtttgctctgggggaggcggaagcggaagcggcagagggcgacagccccgacgagcagaggcggaggagggagaggatccaggagactgttgccgcgctcaggaacatggtccccgggggcatcgcgaaagacgccgcggctgttctggacgaagcgatctgctacttgcagtacctgaagctgaaagtgaagacgctgggagctgtcttcctctagctaagcctatctagccctctctcctcgtcgtggtg

SEQ ID NO: 79756 - DNA, 459 bp, Zea mays
  Clone ID: LIB3088-043-Q1-K1-B5
cccacgcgtccgcccacgcgtccgagcacacaagctttctcatggccatagcggacacggtggacatggggcctttggaggctatggtcacggtggttacggccacgggtatggtggccacggcaagttcaagcatggtcacggccaccacggcaagttcaagcacgggcacggcaagttcaagcatggcaagcacgggcacggcatgttcggcggcggcaagttcaagaagtggaagtgatgtgccctccatggttgatcgtagctgaactcaggcttccaggacatgtgttgccagtaataccttttcagcgttactcatccttcatctgtatttccagtaatccagcttgtggcgagtgacataatgctaataagtgacataaataaccattgctgatatgctgtatatgttggtctttgggatggagcgctctgaagattatattcattggcaat

SEQ ID NO: 79757 - DNA, 329 bp, Zea mays
  Clone ID: LIB3088-043-Q1-K1-B6
gcctctttcatttgccgtacgtacgtgtggtacagctgcgatgggctcgggcttcatcgcgaagggcctcaccatcgtgaacagcgccgggccagggaaggggcaggccgtggcgctgcgcgtcggcggcgacctctccgtggtgtaccagtgcgccatccaggcgtaccaggacacgctctacgtgcactccggccgccagttctacgccgacgacgacatcgccggcacggtggacttcatcttcggcaacgccgccgtggtgctccagagctgcgacatccaggcccggaggccgagccctcggcagaaggacacggtgacggcgc

SEQ ID NO: 79758 - DNA, 389 bp, Zea mays
  Clone ID: LIB3088-043-Q1-K1-B7
gagcgctcagggctagcaggtatttgctaagatctggatttcatgttacaccaatgagacgacccacggtgccacccaactcatgcaggctgagaatcactcttagtgcttcccattcctcggacgacatcaaaaggctggttgatgcactcacaccatggctccctgtcaaatatggtaatgggagctatgctacagcttcaaaactctaacccatcggaggagagtctggtatcctgcggaaagaggcggcatgctagtgggtggttgacgcgtacgcatttatatattctgtggcgtgacgcctacgtccttccccatttataagcaaatattactgttttgttagatatcaatgttgaaataggcttattattattattattagc

SEQ ID NO: 79759 - DNA, 429 bp, Zea mays
  Clone ID: LIB3088-043-Q1-K1-B8
cccacgcgtccggcgccggacggcggccgatctagctcgctgcgtcagcctgtcagcctggcgtgcgccgctctggtgccactgccacggcaacagcacggcatggcgccggcataggtcgctaggaaaaacctgcttttgtgttcgggttcacgtcgtgtcctacgtggcgcggcgggccccgcctagtaaaggagcgtaggagcgtcgttttgtgttgtggtcgaataaataatgtgtctgtgtgccgatcccgtgtcgggttagtgggcccactgtcggtgctgatgtggcctgcctttacagcacatcggtggggctgggccgtagagctcctgtgtcgtttaaatatatgtgtactctgtactgtaccaactagtatgtgtttcgagtgtgtaagaagcatatttgtgtcccatccatctttcg

SEQ ID NO: 79760 - DNA, 392 bp, Zea mays
  unsure at all n locations
  Clone ID: LIB3088-043-Q1-K1-B9
cccgcacaacggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgccagggccgcacgctctacggcttcngcggctaagccgcctccccttctgatgctttgat

SEQ ID NO: 79761 - DNA, 335 bp, Zea mays
  Clone ID: LIB3088-043-Q1-K1-C10
cccacgcttccgctcttactagctagggcagtgattgatgaagtattaattcctggcaagggggatgaaatcagcattaagcttcggccgaacagcactggccgccaaactgtccagatggcgcgtgctctactgtcagctcaccattctcgtgagcgcatactgcggtgctcgggctgtggcactggatgggctgtggacgatactactgacatgatcactgagctcttggcggaatacaacactggtggtgacctaggagacgcctgcagatgcatgcgtgatcttgtgatgcccttcgtcaaccatgaggcggtgaagatggcactggtcat

SEQ ID NO: 79762 - DNA, 182 bp, Zea mays
  Clone ID: LIB3088-043-Q1-K1-C11
gtctcgtgttgcttgatttcgtattcgttaatttgagcctgaatgtttctgtatgcatcaggatttgctgatgataccaccggcaattgcagttgctatctctaagactcttactggattgtattgtatgctgtatggtgtgagattcggtgaaacaaattcgtatttggcagttcgaattt

SEQ ID NO: 79763 - DNA, 406 bp, Zea mays
  unsure at all n locations
  Clone ID: LIB3088-043-Q1-K1-C12
gtgttgaccaactggtggaaataataaagattttgggtactccaacaagagaggagatcaggtgcatgaatccaaattattccgaattcaagttccctcagataaaagcccatccatggcacaagctttttggtaagcgcatgccacccgaggctgtcgatctcgtgtcaaggctgctccagtactcaccgaacctgcgctgcactgctgtcgacgcctgtgcccatccgttcttcgatgagctgcgggaccccaaggcttgcctgccgaacggacggccaatgccaccgttgttcgacttcacagcagccgaactcgaagggctccccgccgagcttgtccaccggatcgttcctgaacacatgaggaaggaagtgaattangtggacggacgtacttggggcaa

SEQ ID NO: 79764 - DNA, 407 bp, Zea mays
  unsure at all n locations
  Clone ID: LIB3088-043-Q1-K1-A7
acccgggtccgacccacgccgtccgcccaggcnntacnnnnacgcgtgggctggactctgtgggcatggcatcatatagctcgtggtgagcgcggcatataattaccactgtgtgcactcaacatttacaccacaacatattgtgccttcttgtcacttccatgtccattgatttcatacacgtgatttggttggcgtggcctatactgaagatgaaactaatgcaatggctgctgaaattgaggtagttgatggtcctaatgatgacggtgaaatgttcacccgcccttttaaactgagcgatcgcttaccacagtcttatgcaaacgagcaatcaacccggtttgctaatggtggtgcatacccttcggaccttagtcttatcacaaatgcaaggcacaattgtc

SEQ ID NO: 79765 - DNA, 208 bp, Zea mays
  Clone ID: LIB3088-042-Q1-K1-H10
cccacgcgtccgtttcaaaaggcttctagtgaacaggatattttcaattcctagtgagaacttgtgtaacagaggaatccaagtatttcatatcaaagtttaaaagtcttatcgagggttcgcggtatggatgtatcctgtttcaaatgatttctcctaatgtatgaatgaaaacggttaatggatgccccagtatgcattgcttttc

SEQ ID NO: 79766 - DNA, 363 bp, Zea mays
  Clone ID: LIB3088-042-Q1-K1-H11
ccggctcctgcgtcggaattctagggtctctacctttcctttggttttatcgatgtctcttgtgtttgtgtaagctagcaaacggttccagaaagcttttgttaagattttgatgacgctaagaggattgatgctactatgctgtactcaagattccatgctgcattgcgatgctaaattaaagaacctctgctaccttactttaaaaaaaaaaaaactgaatgagggcaagttgctatgccaaaaacgtaatcaatacaacgcccggactgtacttacccaggagaagactgacttcaactagtgcaaaaactgaagcacatggtgagacggactgagatacgcacacttaattgccaacca

SEQ ID NO: 79767 - DNA, 296 bp, Zea mays
  Clone ID: LIB3088-042-Q1-K1-H12
cccactcgtccgaaaaaaaaaaaaaaaaaaaaaaaaaaatattttaaaaattataaaagaataaaaaaaaaaaagatacattggaaaaataaaatagatattatcatactaaattcaatccaacatacccaaacattcaaactacttaactatctatatcctcacgttacttaactacaattatcatttcatttcatatcactttacactttctaacctctatttcttacacatcttaatcgattatccttacaacctcttttactcccttaccatctttcgcaatacgccctttc

SEQ ID NO: 79768 - DNA, 282 bp, Zea mays
  Clone ID: LIB3088-042-Q1-K1-H2
cggacgcgtggggtgctccatgcttgacgtttaaaaaaaaaaaaaaaaaagaaaaaaaaaggaaaaataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcgctttagatattaaatacacaaaattttatatgatgctaaattcatagtcttacttatcatttaccaaaacataattatatagcatgagtagtaatattaaaactatgtgaaaaattaa

SEQ ID NO: 79769 - DNA, 232 bp, Zea mays
  Clone ID: LIB3088-042-Q1-K1-H3
cccacgcgtccgcccacgcgtccgcggactcgtggggaatgcacatcttacgatttttggggaccagtattcataggtttttagttagcaatgtgttgttggcccgttgctagtccttgtaatacaagcccacctgtttttttgcgcacggcaagacttaaactgacaacattttgtagtaccttttattttgtatcacctgctctatacacgagttttcttggaacatcgg

SEQ ID NO: 79770 - DNA, 420 bp, Zea mays
  Clone ID: LIB3088-042-Q1-K1-H4
tggatactaatgctgttgcacataagaggagctctgaagatgaaatcctgaacaacaatggtagtaaccataagaaacatagacatgaagttggtttggaagttgatgaaggaaatgatgtgtgccctgctgtagcagaccctaatgggaaacatgaaactggagtaggtggatctttagggggagctgcagaatctgctatatgatagctgctgtatcattcagttggctgtttgcagattgattgatgatgatggagaatgctgaactggtgtttattatctccctttctgatttaggagttttatttgcagggcatgaagatcttcggagaactcgagtgctgttcggagcgctcatctgatatattaaaatgcttatgattccatgaagagttgttggagcacatttctgggatgt

SEQ ID NO: 79771 - DNA, 353 bp, Zea mays
  unsure at all n locations
  Clone ID: LIB3088-042-Q1-K1-H5
gataccagcttgagcgtttcattgtctgaagggtcttgtgctgtgctacaagatagtgtggcctctggcgttggaagcgaaggggaccggggcatcttgtggctggtgtgtatcatcttcctaccatcctaggacatctaattagtttgattagtttcttccccgttctagtggactcggttgctgcttttggctttcaccgaatcctctccaaaggtggcgctggtgctactgttccttatggtgatgattttacttctgaccatgattgttacagcggtaaggctgtcttaggatcttttaacctttaagcatggagacgactntatatacatgtaagtaaggtgaataat

SEQ ID NO: 79772 - DNA, 420 bp, Zea mays
  Clone ID: LIB3088-042-Q1-K1-H6
tggatactaatgctgttgcacataagaggagctctgaagatgaaatcctgaacaacaatggtagtaaccataagaaacatagacatgaagttggtttggaagttgatgaaggaaatgatgtgtgccctgctgtagcagaccctaatgggaaacatgaaactggagtaggtggatctttagggggagctgcagaatctgctatatgatagctgctgtatcattcagttggctgtttgcagattgattgatgatgatggagaatgctgaactggtgtttattatctccctttctgatttaggagttttatttgcagggcatgaagatcttcggagaactcgagtgctgttcggagcgctcatctgatatattaaaatgcttatgattccatgaagagtttgtggagcacatttctgggatgt

SEQ ID NO: 79773 - DNA, 383 bp, Zea mays
  Clone ID: LIB3088-042-Q1-K1-H7
gcgctttgatgtcacaacttggccaacaacaagctggacaggatcggacacaatcaggctctggtgcaggcggtgtcaacctcaacaccttgatgaacatgttcagcgggcttggtgctggtggtggcctaggtgttccaaatgctcctaatgcaccgccagaagaactgtacgccacacaattagctcagctccaagaaatgggtttctttgacacacaagagaacatccgagccttggccgctaccgctggaaatgttcatgctgcagtggagcgacttcttggaaatatgggctaatagaatatgatgatcataactgtactcagatattgtgatttttagttggcattgtgagatcatgtctggctcattgggtttaca

SEQ ID NO: 79774 - DNA, 420 bp, Zea mays
  Clone ID: LIB3088-042-Q1-K1-H8
acggctgccgcacatgcggtggctctgaagcctctcgagctctaaccacactcgtactaattgctgggcgacaacatcgggaggtacatggactcctcggcggtgaaggtcgtccagggcggccccgacgtcggagtgcagctcatggagcaccgctgggacaaggtcctcttcaccgggagtccccgcatcgcgcgcgccgtgatggccgcggcgtccaggcacctgacgcccgtcgcgctggagctgggcggcaagtgcccctgcatcttcgacgccatgggcagcgcccgggacctgcagatctcggtgaaccgcatgatcgcgggcaagtggtcgtcctgcgccggacaggcctgcatcgtcatcgactacgtgctcgtcgaggagcgttttgcgcccattctgatcaaggtgctc

SEQ ID NO: 79775 - DNA, 341 bp, Zea mays
  Clone ID: LIB3088-043-Q1-K1-A10
gtgaaggaaaaatatactcaaaccctagctgccgatctcgacggagaacacttgtgtctggttagacatgaccgtctgtggcacccattctgcccggatctttatggacctttacaccaactatgtgcctaaaaccggccataactttcgtgcgctgtgcacggccgagaaaggcgtgggttagtccgggaagccattccattacaagggatccaccttgcaccgcgttataccggagatcatgtgccacggcaagaacttcacccgaaggaacaggaccggcgacgaatccatctactgatagaagttccccgacaagaagataatgcgcaagcacaccg

SEQ ID NO: 79776 - DNA, 256 bp, Zea mays
  unsure at all n locations
  Clone ID: LIB3088-043-Q1-K1-A11
cccacgcgtccgcggacgcgtgggcgagatcggtaatacagtaatgctcctcaatgttacggaaaaaaaaaaaaaaaaaaaaaaaaaaaaaaaaaaaaaaaaaaaaaaagaaaaaaaaaaaaaaaaaaaaaaaaaaaaantgggggagggtgggaggtngtaaaaaaaaaaaaaaaggtnnntaatgggggggggaatggttgaaattttaaaaataaagaaaatgaaaaagagtttgaaagtacataaataaaaa

SEQ ID NO: 79777 - DNA, 372 bp, Zea mays
  Clone ID: LIB3088-043-Q1-K1-A12
cccacgcgtccggaggaatatcaaattcgaaggctgacagcacttgtaatcgaaaagctgttccaaaaaatagaagtgaagatgtcattgttttcagagattgagcaggtggtctttcgaacgagagagtacaccgagaagaccagaaagaagctcctgaaggaacgaaatgcgattattgcagctcggatgggcgcattgccgtctaggccaaaccagacaggtgtagccggaaacaggttaccacctgggtatggcaaccctcctgtaaggcctccaaacgcaatgcctcggcccaccagctgaagaaattccggattccggacacccagtgatctataccccattcttttagaagcatacccccaagac

SEQ ID NO: 79778 - DNA, 195 bp, Zea mays
  unsure at all n locations
  Clone ID: LIB3088-043-Q1-K1-A2
acgaataaaaaaaaaaaaaaaaaaaaaaaaaaaaatatatattancaaatattgtaaaataattggggagggaagattattaaatatacaggcttaagaacttataaaatggggcgtcctttttaatatatccaaacttctttcccagtgcatacaatggtaaaaatttaatatattgtcccttaaattaaatta

SEQ ID NO: 79779 - DNA, 283 bp, Zea mays
  unsure at all n locations
  Clone ID: LIB3088-043-Q1-K1-A4
cccacgcgtncgctagatcgcgagcgggccccttttttttttttttttaaacaacatatcagacctctggtactcaaaaaatcccgacaagccagtaccatgtccatacaaaattgcaacaattactcataagtctaagtagggagggtcgactgatgcaacacagccagggcagcataaggtacttataagctgtaacaaaataggccttgaaaacatctcaaagcactgatcattcttaggcagaggtggcagcagaagccttggcggcggcagaaagctt

SEQ ID NO: 79780 - DNA, 441 bp, Zea mays
  unsure at all n locations
  Clone ID: LIB3088-042-Q1-K1-H1
tgttctttggaggccttgtgggttttttttgcggtcttttaaagccgtatttggtgaagatatttgtgggtggtccttttattcactaatctttgtagcgtgatcttcaagctccggcaaacaatggacgttccattttggttttttgatgtaccctttttttagatgttgttttgtagaacaccatgcaagcttcacactcatagggcgaggcaccaggaaaaaaatctcgctggaacctattttgccagctagtattacatgctgagttgccggtgaaactaaggcaccagttacattacgtaatgagcacacgaagactgtcgtacaatctgngagcaaggatcaccaaaccgttttgggtaaaaaaaaactgctatccacggtagaccggtgaaaaccggcaaaatcgacaaggatcaccaaccgggtttttttttg

SEQ ID NO: 79781 - DNA, 385 bp, Zea mays
  Clone ID: LIB3088-043-Q1-K1-A5
gaaggcgaccctccctccttcgctccttccgcgccgcctcccggccgtcgccgccatggtgaagtgctcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatacctgtggggtgttggtcgcaccgcgcaagctaagtcgcgccactccaatgggcagggcccgctgcccgttaaatcagccaggttcatcctggatttgctgaagaatgctgagagtaacgctgatgtgaaaagcttggatgtg

SEQ ID NO: 79782 - DNA, 169 bp, Zea mays
  Clone ID: LIB3088-043-Q1-K1-A6
gctgtgctgaccacctcccctgttacgcgggcgacacggaaactacatcgggtctcacggggcggcctgtgacatgcaccggccgcctgtagcgtcacggctgaggactatacatttggagctcatatctcggaagaaagaggagcggtgaggtccagccccccgttgc

SEQ ID NO: 79783 - DNA, 430 bp, Zea mays
  Clone ID: LIB3088-044-Q1-K1-E5
cccacgcgtccggcgattcagggtgaaccatcagattgtctagtgtcttctttgtaataaatttatctgttcttggtactttgtctatggttgaatcggaacccattttccgtttgcctagattcttaatttctggtgctgtatccagctgaaactagtagatctatgatcttgcggctgcagcatgttcttgtcacttttatctggtctccgttggttcggttcacaggttgtgtgctttaaaaggctgtgcttaagtcctgcaattcgagtccaccaaactgtagggtgcaagtcgagattttattagtgatgcaagttgctggtattggtgcattatcgggctaatacgcttgcgttgccttctgattttataagtgatgtaaattgctggttttaacgtgcaaaaaataaaaaaaagggcggacgc

SEQ ID NO: 79784 - DNA, 243 bp, Zea mays
  Clone ID: LIB3088-044-Q1-K1-E6
cggacgcgtgggggactctgtggtgcttgcgatagctttgccatcgatgctgacattatggatgttcaatttgagcaaacgtaataggtatgggcatcaaattaatgtaccgatacatgtatgatgctcaataatgtatttgcgcaatactagtaaacgcatagactgtatgaacgagtacttgcttactccgtgatatgttgatcaatgttttctggacttagcagacgatctaaaagatcc

SEQ ID NO: 79785 - DNA, 325 bp, Zea mays
  Clone ID: LIB3088-044-Q1-K1-E7
aagaagagttgtgaggctgagtcagaggagtgagatgatgcctgagtttgtggcgacaaatgcatctcttgtatcgttagggtcttagttgtgaacttaattttcacatctgtatgattaaaagagattcatcaattggtactgaagtgttgtttatttgtcttgttgcctatctggagtttatttaactaaaatcatcagttgtgtccttgagaatcgggcacttaatgtatcattttcggttctctgtgaaaaaaatgaaaaacgtatactaactatacgcatgcacttgtcaataacaaaaaaaaagggccctcctatatct

SEQ ID NO: 79786 - DNA, 436 bp, Zea mays
  Clone ID: LIB3088-044-Q1-K1-E8
gggctttgatgggatgtatgcgtcaataatctcagagcagatgacaacacagagattacgtgagattatgtacaggtccatgaagaggtacagcagatgacattcataggcaaggatttagctaaaacttatcgagtaaatgaaacttattaaggatcacttgctagtatgcctactcgatcatactcatacacctgctacagctagtaagaatacttctatgatacaggaaatggatgccacactatgatgatagggtactggatagcaactgcacttactaagaccaaactgactagctcgataattatggtgctgacatcagagatacagtatcaaggctgctctggtcctttttccattactgggcatatgagcactattacacatgagatgtcatatcaattcgcactggacggattatcagtaatgaacg

SEQ ID NO: 79787 - DNA, 376 bp, Zea mays
  Clone ID: LIB3088-044-Q1-K1-E9
cggacgcgtgggtgaatgatggtccccaattttttcccttcccatccatgtttgcaaatggtacacaattttgtttgtcacttttgtgaaccgttggagcagatatcttcaaaacaggctgcagtctggaaatattgacacaggaaactattttaacagtcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaatttaaaaaatccaaaaataaaaaaaaaagggggggccctttttaaaggtccaattttttcaccccgtttctataaacttataacttttttttaagggccc

SEQ ID NO: 79788 - DNA, 353 bp, Zea mays
  Clone ID: LIB3088-044-Q1-K1-F1
cggacgcgtgggctaagggcatgatgggaagcctgcagatcagaaccatggaaattatggatgagctgaggaagtctgtagatcagaatatgccgttctacattttcctttcccctttgtagctaccatggcaataacaatgagaccatcaaacagctgtgcatttaagtatggaaatactcccgtctgtgtctgtaataaggacgtttcatgtggctgaaacctgccaattctgttaatttttgcatgacttcttgttcaactggtgtgaattgtatactttgttcacgaagcactgatcataaaaaaaaaaaaaaaacaaaaaaaaacaatagaacacaaataatatacct

SEQ ID NO: 79789 - DNA, 415 bp, Zea mays
  Clone ID: LIB3088-044-Q1-K1-F10
ggcgcgggcgctcgcaccaccacagccacttcccggtggctgtcatgcgctctggctcaaatgcatttggtggcatgggagctgctggtaacattaaggagacattcacagcgcttgaaatgaataaggcattccgatatgatatctacaaaatcgaagagaagcaaaagctggtggttgaggagaagacaggggctactactgaaagctatgatgatgtttaggactatctgccagagaatgactgccgatacgcgctgtatgatactgattgcgatactggggagaatgtgcagaaaagcaagattgtcatcattgcctggtgcccatcgacatcccgcatacgtgctaagatgctgtactacacagtcaaggaccgtatcaagtactagcttgacaggttccactacgaaat

SEQ ID NO: 79790 - DNA, 428 bp, Zea mays
  Clone ID: LIB3088-044-Q1-K1-F11
ccgccgtctagctgacatggctgacactcagttcattgcgaccacattccggccagagattgctaaagtggctgatcagatatatgccgtgagacacaagaatagggtgagcaacatcgacgtggtgtccaaggaggaggccctggacttcatcgagcgtgatcagacgtacaatgctagctgaggctgctgctgctgtgtattgattgatctgcaggcagatgctaacgcagacaggatagttcttgttgtgttatggatattctggcctattgttgtagctgtgtatatgtgtgatgcagttaggtagctattggaccagcttgtttggcgcatcaacgttgtgaatgtagcagctaccaccttggtttggtaccagctttaattaagtttgggaagcgctgattagactagacgtacgttacatg

SEQ ID NO: 79791 - DNA, 356 bp, Zea mays
  Clone ID: LIB3088-044-Q1-K1-F12
ctctgcaccgttgctagcttgttcagcacgatgcgcatggtccgtaggtctgggtaggttgatgtctcaaggagcgtgttgttggtaaacaaagctgtaggtgttcagtgattgtctacatggtatacgtgaccagctatttaagttcctaggtttgtaacatgtatgtccgcctgcagttcagttgagatgcttcaaggctaaggttctgttgtgtgacctgtagacacgaggctgtcagcttgtattctcttggtaatgtgtgtcagcagagcgttagcattaagtctaattgaacagtgctgttatctgtaacgtctgagtttgatcagaaactgaagttaattgaggaagac

SEQ ID NO: 79792 - DNA, 434 bp, Zea mays
  Clone ID: LIB3088-044-Q1-K1-F3
aggacagcaaggtcgagtcgaagcagagcaaggggaacgcgctgaacgagctccttgagctcaggagctgctccagctgtcttttcttcgagtgcagaaaacagaaggatctttacctttggatggtgaagtctcctggaggaccatcagtaaaatttctagttaatgctgttcacaccatggaggagttgaagcttaccggtaaccatctgaaagggtcacgcccacttcttacattttctacaaattttgatgagcaacctcattggaagcttgtgaaggaaatgataactcagatatttgctagtcctaaagatcaccgtaaagcaaaacctttccatgaccatgtgtttgtcttctccattgtggatggccatgtttggtttcgaaactaccagatttcggttccccacaatgagattgataaagttgat

SEQ ID NO: 79793 - DNA, 285 bp, Zea mays
  Clone ID: LIB3088-044-Q1-K1-F4
aaaaaaaaaaacacacgtacggacacggacttaaaaaaataaacgcacaccagcttactcgggaacaagtgaacacttcatagcatctaaagtatttgtcaggatggcatgatagggaaatgcatatgactttggacacacttgaaaaacgcttgatctggcttacaatgaaacatgatagggtcactgggatgattcactaagatctataattggttggagcactatgtaccattttcagtgctattatgtatctgtacaattctttatactgcggtttgaact

SEQ ID NO: 79794 - DNA, 436 bp, Zea mays
  Clone ID: LIB3088-044-Q1-K1-F5
cggacgcagtgcgaaggaccctcaagcgttgaacttgcagaccgagctgattaagggtatgacctgctaacagctgtctttactacgagtgcagaaaacagaaggatctttacctttggatggtgaagtcttctggatgaccatcagtaaaatctgtagttaatgctgttcacaccatggaggagttgaagcttaccgggaaccatctgaaaggttcacgcccacttcttacattatctacacattacgatgagcaacctcattggaagcttgtgactgaaatgataactcacatattagctagtcctaaagatcaccgtaaagcacaacctttccatgaccatgtgtttgtcttctgcattgtggatggccatgttcggtttcgaaactaccagatttcggttccccacaatgagattgatccagttgataaagg

SEQ ID NO: 79795 - DNA, 397 bp, Zea mays
  Clone ID: LIB3088-044-Q1-K1-F6
cccacgcgtccggtcacggactcgcgtccacaaaccacaaccagctcactcaagaacaaaagaacacttcatagcatctcaagtttttgtcaagagggcagagagggaaatgtttatgactttggacacactggaagaacgcttcaactggcttacaatgaaacatgattgggtcactaggatgattcactaggatctataattttttgtagcactatgtcccattttcagtgctattatgtatctgtttaatcctttttactgcggtttgaacttgatgtgacattattgtggatggattgtacctccatctattattgcaacatgtttggaacttgttatgagaattatgtttagctaaaaaaaaaaaaaggagaaaaaatttaaagattcaaaa

SEQ ID NO: 79796 - DNA, 420 bp, Zea mays
  Clone ID: LIB3088-044-Q1-K1-F7
aggtatcagaagcagcacaatagcgaggctgtgcatgactagctcttttactggaggatcagtaccagcttgatttgctgagcttgcacactacagacggatctttacctttggataatgaaatcttctgggggaccataaatataatatatagatattgatggtgacaccctggatgagttgatgctttcctgttacgcatatgaaagggttacgcccacttcttacattttctacaaattttgatgagcaagctcattggaagcttgttaaagagatgataactcagatatgcgctagttctaaagatcaccggtgagcaaaaacttttcatgaccatgtgtttgtcttatcatttgacgatggaaatgttttgttttcaaactatcagattttggttccccataatgagattgataa

SEQ ID NO: 79797 - DNA, 224 bp, Zea mays
  Clone ID: LIB3088-044-Q1-K1-F9
gttaactcggggacacgattagcatagcattttgtccctggggctgctttccatgtcaggtgaaaacaatacaaaagctatcgtgtacagatgcaatgtattttcgttctgattttgtagcgcttaaaaaaaaaaaaaaaaaaaaaaaaaaaaaaaaaaaaaaaaaaaaaaaaaaaaaaaaaaaaaaaaaaaaaaaaaaaaaaaaaagggcgtccattttacaa

SEQ ID NO: 79798 - DNA, 163 bp, Zea mays
  Clone ID: LIB3088-044-Q1-K1-E4
ctgaatcgctgtgaaatatgcgttaataattttatctcagatgttaaaacatggagatatgggggaatattgtcaactatatgaataggtacaggcattaaaattaattgtgcagcattttgctaaaactcaaaatgtaaatgaaacttattacggaacactt

SEQ ID NO: 79799 - DNA, 218 bp, Zea mays
  Clone ID: LIB3088-044-Q1-K1-G1
aattggccaagctgcgtgtcaaggccgagaaggcagccgaggagaagttggggtctcagttggagattcttgcccctatcaagtactgaggagctgtgctttgtcatcagttttggggaacatctagtctttgttttaagtgttcggtaacagtttgtgacagtataatctggtaaaccgtgttatttttctgccactcctatttgaacacattttct

SEQ ID NO: 79800 - DNA, 400 bp, Zea mays
  unsure at all n locations
  Clone ID: LIB3088-044-Q1-K1-D1
cccacgcgtccgctgcgccaaaatctggtgtcccttgcaaatcgtgcagcaagtcattcagcagtgagacggcacttcaggctcactcgaaggcgaagcatgggggcaagtgagtcgcaggtccaatagagtcaacaacaaatgcgaaacatgggagaggagtcgggtttgttgggaaggaaaattagattagtatcagttttttttgaatgggatgggaacgtggctgtgaatctcagggttgtatgctcggtgaagaaaaaaatggaaggacttcggaatgcacgatgttgatgccgaatattatccagcgtaaaaaaaaaaagtntttccacgtgntgataaactttctcaacctaattgctaaaatagacataaaaaaaaaaaaaggggcggccgt

SEQ ID NO: 79801 - DNA, 420 bp, Zea mays
  Clone ID: LIB3088-044-Q1-K1-D10
cccacgcgtccggaaaacaagagcgcaatgtaagcattccgtgaggtgcttgagaaggagctctctggcgttaacttgcgcagtgattatgaggatggttatgaagaggaagatgtcaactcaaaaggctgtgacaacaaagggaccttatagaatacctcttgtagaaaagccagaaatcaagaaggtctgaagcaacaatataatggagaggaagaccaaaatggtgggagcaatgcaactactggaggtgctcggaaaaaaaagggtgggcatgtaagacaatcaattgctactcatgatgccattgataaaaattatagtggcagttcaacttaaggtttaaggaacaagatacagaattctgctgttcaaagcgcttcggtaagcagaagggaagggttgaagcaacgatctgat

SEQ ID NO: 79802 - DNA, 432 bp, Zea mays
  Clone ID: LIB3088-044-Q1-K1-D11
cccacgcgtccgcccacgcgtccgcccacgcgtccgcccacgcgtccggcaccacaggggagctgctttcccagcttgtcgacttgctgaagctgtctggggctagacacacgattctctacgcttcccagccatctggttatctactggagaacccttccggctcgccagtggctaggcaccttgcggagaggactaacggtacaaaaactggcctactgagcaaatgtgacggagagtgcctagtcaaatcaactcttcttgaaggaacctttgtcggaatagtgctccttatcatcttgatatcagggctcatgtgtatgatgggaatcgatactccctccaagtttgaagctccccaggagtcttgatctcccttcgaagcagaacccttgttttgttggtctgcactgtggatagatattattcagt

SEQ ID NO: 79803 - DNA, 438 bp, Zea mays
  Clone ID: LIB3088-044-Q1-K1-D12
ctccctagcaatctctagcagcagatcctcgtgcaaagcaaagcgctagccttcctactgtcccgatggcccgcacgaagcagacggcgaggaagtccactggcggcaaggcgcctaggaagcagctggccacgaaggcggctcgcaagtctgccccggctaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggatttcaagaccgaccttcgcttccagagctccgccgtcgccgcgctgcaggaggcgtccgaggcctaccttgtcgggctcttcgaggacaccaacctctgcgccattcacgccaagcgcgtcaccatcatgcccaaggaca

SEQ ID NO: 79804 - DNA, 447 bp, Zea mays
  Clone ID: LIB3088-044-Q1-K1-D2
cgcagtccttcgaggacgcgttggagtacgccttcggccagatctgccgctaccctgaagaggggcctggtactcacaatgcgtgatcactgggacatgtgtctacctctgatccatcctgaagtaccttgctgcatacgttatggagttggcagggaacgcggcgagagacaacatgaagacgctcatcattccgcgccacgtgcttgtgacgatccgcatcgactatgagctcggctagctgctggcaagtgtcaccatctttcacaggggcgtactgggcaacatccagtgcgtgctaatgtccaagaatgcggcggaaaaagcggtcagcgccgtcagcaaggagcccaaatgccccaagaagggcgccatttccaacaagaaggcttacaaagtagggactgtatttgcactgtgtgctgtagcatgctcgcgtctagatct

SEQ ID NO: 79805 - DNA, 319 bp, Zea mays
  Clone ID: LIB3088-044-Q1-K1-D3
gtctatagtgtaacaactacgataagtagcaggaagattgagcgaagcttgagttatctgtgaaacgatgaaaatgtctaacgcactgaattagtcttctttaatatttttcataaattaaaaaaaaaaataaaaaaaaaaaaaaaaaaaaaaaaaaaaaaaaaaaaaaaaaaaaaaaaaaaaaaaataatgtaattaaaaaataaaaaggtaggaccttttaaatgttaaaatcttaaataactttaatggcacactaaaacctattaattgggggacctaaaaaaaatttaatccggggaaaatttaaaaagtttcc

SEQ ID NO: 79806 - DNA, 320 bp, Zea mays
  Clone ID: LIB3088-044-Q1-K1-D4
accacgcgtccgaccactcgtacgcccacgcgtccggttctccccagccgcaagccgaagcgggcgccggcgggcgggacaaggcagaggccgaggccgaggacaaggaggagtgacgggtgtagtcaggggggaacgggaacggctggagttgtttgcgtctcgcgttcttttcacctgtacgcaggaaatactcctcctgcataagactactgtacttttggataaaaaattttatttctacaaaaaaaaaaaaaaaaataaaaatgaattaaaaataataaaaaattatataagaaaaattaaaaacacatattatg

SEQ ID NO: 79807 - DNA, 55 bp, Zea mays
  Clone ID: LIB3088-044-Q1-K1-D6
cccacgcgtccgattttttaaaaaaaaaaattaaaaaaaaaaaaaaaaaaaagag

SEQ ID NO: 79808 - DNA, 143 bp, Zea mays
  Clone ID: LIB3088-044-Q1-K1-D7
cggacgcgtgggaaaaataaaataaaaaatttaacaaaaataaaaaaaataagggaaacaatgaaaaattaataacgcactgaaattaatcttatttaatatttttcataaattaaaaatgcaaaatactctactataatata

SEQ ID NO: 79809 - DNA, 238 bp, Zea mays
  Clone ID: LIB3088-044-Q1-K1-D8
cagagctctagcaaagacggtgttccagctttaagcacttacagctaaatttgggaaactggggccgttaaagggctaacgtcacaagcactgacaattaatgttgatgagcacagacagggtggaacgaaaactgctatagactctctgaatgtaagtcggattcatcgatatgcaatcagatatctaactgtgtaaaactactggacttctggataaaagagcgtactatttcaaa

SEQ ID NO: 79810 - DNA, 430 bp, Zea mays
  Clone ID: LIB3088-044-Q1-K1-D9
cccacgcgtccggaaccttgcaggtttcggggtttcagtattctcccagcccacagaggggtagtgagtgccacatatcatcttccactgatatagcattcagtttttgtattttcagtaatgcagtagtaatgtacttatggcagtatgcactttgcggctgaaattttagacggttcaacttcagagatggctaacaatgggtctgagtcaacaatggatgcgaagcgtagggccagtcctgtaccagcacatcataactccaggcagatgaacaacaatcatcattctacaactactactactaccaccaccacgtcatctgctccagctaaagtgacaaaggagcaaaagcagagtcttgtggaccttgacaggcttgattctgccaggaagaggctccaggagaattaccaagaagcacaaaatg

SEQ ID NO: 79811 - DNA, 447 bp, Zea mays
  Clone ID: LIB3088-044-Q1-K1-E1
ctcgttggggtcggcttcaaagcgaggtcagagagccaaggccgtgagttgttccttaaactgggcttcagccatgaggtgcagttcaccgctcctccagctgtccgtgtcttctgcttcaaacccaacataatctgctgcaccggcatcgataaggacagggtgcaccagttcgccggcgccatccggagctctaaggctccagaggtgtacaaggggaaggggatcctgtacattgacgaggttatcaagctgaagcccggaaagaagcgaaaaaataagtgacgatccgaaggcgttacaactttttctgtcttttaaccccatgcttcgcatttgtagtgatctggatctggggtctgctgtgttgtgttgtgtacttgcgttgtgctacacagatcaccattatcttacctttacctcagctgcatgtaggaccatgagtgg

SEQ ID NO: 79812 - DNA, 436 bp, Zea mays
  Clone ID: LIB3088-044-Q1-K1-E10
gaaatgatgggtgatcctgcatatcttattgctgtcatcatagagtttctacggagtgtgtcaaaggctgggcttaaggctcctcacaacctttatgtgatgacggcgacactactagctcgtagcaaccgttacgctgaaatagcattgtttgtgtcaaacaagattcttgagccgtgtaaagaactggcaatgcaacttatggagctgggtctgcagcacccgccaacgaggaagctgggcatggacatgctgagggagcgaggcctgcatcacgactacgtgactgcgatgctgcaagatgggtactacttggaggccctgcgctatgccagaaaatacaaggtgatcaccgtgcagcctgccctatttctggagaaagccctggcgaagaacagcgcccacaacctggctgcagtgctgagcttcttctgcg

SEQ ID NO: 79813 - DNA, 436 bp, Zea mays
  Clone ID: LIB3088-044-Q1-K1-E11
aaaaaaaaaaaaaaaaaaaaaattaaaaattttaaaaaaaaaaaaaaaaaaaaagaaaaatggaaaaaattaaaaaaattaaaaaaaaaacaaaattaattactcaaacattataaataattgacttctattattccagtctcttaatttcttttcttttgcctaattttttttaattcttgttctgttaaaccccatgtattttcccatattattctgcttttcaacactttcccctttttccatttgacgtattttccataagtcccttacggttcgcccttcctttcagttatgctttctaactgctaattggcaccctcatttttccttatcattaatcccaatgctttttttggctatcggtattctataccctttcctctttaaaccccctatttcctaattttttccctttttttctttcttttctttt

SEQ ID NO: 79814 - DNA, 443 bp, Zea mays
  Clone ID: LIB3088-044-Q1-K1-E3
cccacgcgtccggtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagggtcgaatacttaagttaactatgcgctgacagtctggactagcagtgttatgtgcgctgctggaccttgcgcgcaatgctgtggccgatttgttcgttaatgtcaagaattgtgttacagtgcgtgtatatatgtgtgtcgccgcatttttatttttgagaattgttttaagctgaaa

SEQ ID NO: 79815 - DNA, 420 bp, Zea mays
  Clone ID: LIB3088-044-Q1-K1-C9
cccacgcgtccgcggacgcgtttttgctgtatccatcagggaagatgctacacaaaccaggctaactttacaccgtcaaggtgagcagatcatgcggtctcatcaagtagcagctgacattgagcaggaccttacagtgagtgagaagcttctgggaagtctgggtgggctattttccaagtcatggagaccaaagagaaatcatcagataaaaggaccagtctcaggaaataactattctgcgacaacagctaacgacacggaacagagggggaagctaggaattgccccagcacgtcaagaatatcccagtcatgtacaaaccacactagtatctgcaatggaaaaagttcaagctgagagaacaaagcaggatgatgcactttccgacctgtgtagcacattgggacaactcaagga

SEQ ID NO: 79816 - DNA, 370 bp, Zea mays
  Clone ID: LIB3088-044-Q1-K1-B4
ctcacgctttcgttaatgctctgatgactggtctgacatgtcgtgggacctgacaagcctggactttgcgaagcagctaccatggttctcggcattacaattcaacctacatgcgaacaggattactgctgagactctgactggtgctggtgttcttagcgctgattggaacatcaatggtgactggcttgctgtggagaacacctctgagcttacttttgacctgatattgtctgcgacatgcgcgacacactgagactgacaggacacaaactggtacgtgacaggccatcaaaacggctcggataaggtatgcaagatgtttcactgatcatctgatgacgcgatcaattgccctagcgaatcacct

SEQ ID NO: 79817 - DNA, 185 bp, Zea mays
  Clone ID: LIB3088-044-Q1-K1-B5
aaagcctgtctgtgacagcacagttgcgaggatcacattttggccggcgaatggaggctcgtgaaccgcttatacgtcacagaggagggggctataagcgaatcagtaccaggtaacatacagtgcgtctttaaggcgttggagcagcacctttacacctctgaaggaattctggaaagttatga

SEQ ID NO: 79818 - DNA, 411 bp, Zea mays
  Clone ID: LIB3088-044-Q1-K1-B6
cggacgcgtgggcggcaacggatatctcggctctcgcatcgatgaagaacgtggcaaaatgcgatacctggtgtgaattgcagaatcccgcgaaccatcgagtttttgaacgcaagttgcgcccgaagccttctggcggagggcacgtctgcctgggcgtcacgccaaaagacaaaaaaaaaaaaaaaaaaaaaaaaaaaaaaaaaaaaaaaaaaaaataaaaaaaaaaaataaaaaaaaaaaaaaaaattaaaaaaaaaaaaaaaaaaaaggggcggccgttcgcgatctaaaactagccgggaccatccacgcgcacggccagaaaaccgtcaaaatcccggtgtccctcgtctttgacgacttcaagagcccttacagggacatccagccgggcagaataatccttta

SEQ ID NO: 79819 - DNA, 387 bp, Zea mays
  Clone ID: LIB3088-044-Q1-K1-B7
tcgcccacgcgtccggtttcgatgtgatgcgggtgatgatcttgcttagcaagatgctcatctcgtaggactttcttatgtgtctgtaatataaaataccggacgcgttcgcgaaaagtacaacttcaagagctgaaagaaaggcttctatgcatagttgggaaccctggagactgaattataatgaatggggctgcccgacgttattctggaaaacatcagatgttaagatcaagagcatttctgcagttggtggtgctgaatggaacaagcccgtctagaatgagagcgtctatcaatagagaaggtattgacttttccgatgctcaaaacatgcatccagtgcaggaatgggaattagcatagaacctgcaaggagctcttgag

SEQ ID NO: 79820 - DNA, 438 bp, Zea mays
  Clone ID: LIB3088-044-Q1-K1-B8
cccacgcgtccgcgcgcaaggtctccctggtgcgcgcgctgctctacatcgtggcgcagtgcctcggcgccatctgcggcgtcggcctcgtcaaggcgttccagagcgcctacttcgacaggtacggcggcggcgccaactcgctcgcctacggctactcccgcggcaccggcctcggcgccgagatcatcggcaccttcgtgctcgtctacaccgtcttctccgccaccgaccccaagcgcaacgcccgcgactcccacgtcccggttctggctcccctccccatcggcttcgccgtgttcatggtgcacctggccaccatccccgtcaccggcaccggcatcaacccggccaggagcctgggcgccgccgtcatctacaacaaggacaagccctgggacgaccactggatcttctgggtgggccctctcgtgggcg

SEQ ID NO: 79821 - DNA, 291 bp, Zea mays
  Clone ID: LIB3088-044-Q1-K1-B9
cggacgcgtggggagcttgtattcacgcatgctgctgctgttgccaaacttgtgtaccgggggattacccatcggcgtattccatatgctggtggacacgctcgtgctgtctaacgggctatcgattgtcagacacctgacaacctgggagaatccctaggcaatgatgccggagctgaccatgcgagacgcttgtgacaagctcggcatctacagtctcttcaatttaagactccttctgagcatcgctatgatcgggatctgtactggggctaacttgggaattgacaa

SEQ ID NO: 79822 - DNA, 449 bp, Zea mays
  Clone ID: LIB3088-044-Q1-K1-C1
gcgacgtcgacgggggcctgctgcgacgggaagccgagcgcgcgaagaagatgaagcgcgcgcagtccgtcgccagcggcgcgcagtctgctccgcctccgcctccgcccgcgccgccgcacgtcgaggtgctggagctgcgcgtgtcggaggtgggcgaccacgtgctggtggtcagcgtgacgtgccgcaagcgacgcgacgccatggccagggtgtgccgcgccatcgaggacctccggctccgtgtcatcactgccaacgtcacctccgtcgccggctgccacgtgcacaccgtcttcgtcgaggtagataaaatcgaccacatccaagtgaagaacatgattgaggctgctctcacgttgctcgacgcccccggaagcccccacagctcgatgagctattacgagacctaactatgttgagcaatgcttttccgacgtctacta

SEQ ID NO: 79823 - DNA, 361 bp, Zea mays
  Clone ID: LIB3088-044-Q1-K1-C10
acgatcattacaaaaaaaaaaaaaaatataaaatttaaaaaaaaaaaaaaaaaaaaagaaaaaagaaaaaaaaaaaaaagaaaaaaaaaaaaaaaaaaaaaaaaaaaaaaaaaaaaaaaaaaaaaaaaaaaaaaaaaggggcgaccgttcaaaaggacccaaggtaacctaaacttgcatgcaacgccaaaggtctacaataaagccacctaaattaaattcattggccgatgattaaaaaaaacttaacaggaaaaaccttggaataaccaaattaaatccccttaggaaaaaatccactcttagctactgggcataataccaaaaagccccccactgatcgcccttctaaacagttgca

SEQ ID NO: 79824 - DNA, 388 bp, Zea mays
  Clone ID: LIB3088-044-Q1-K1-C11
cggacactgtcatctcggtgttttgccattcaacagagaacaagattgcttctggtggccttcataatgataggactgtaagattatgggttcaagatagctgatcaacttgcaggtgtggactacgctcagaccagacctaaacagcacttgcctatcaatgagaaaatatgtctgcttcccatggatatggatcgctattccagatacgtttacaacttacacaaagacattaaccatgcgagctttgttttaatctgatgtgttatcctaagttgtgaatgctgaataaatcaacatctagtcatctctaataatgttgtgatatgttatgcccaacggctgtattccaatcaatattgatttattttgcaaaaaacaaaataac

SEQ ID NO: 79825 - DNA, 430 bp, Zea mays
  Clone ID: LIB3088-044-Q1-K1-C12
agcggttcggcgcgcggttgacttagatctttaaacgcgtggaggccatgaacaaggacccgcgcttcaagaaccgctacagcgcggcccagttcccctacaccctgctcttccccaacacctccgacaagggcgataacaccggcgtcaccgccaagggcatccccaacagcatttccatctgattcgatcgagtcctggccagcgtttcacccaaaaaagcagagctagcggtgattcccgtatgtcatccgtttcattttttacatgaatgagaagcgtggtaataaaaaggtttgtagttgcgtgcgcgccgtgtattccttggtgtactggtgctggcggtaaccacttattaccagggatccttgtaatttttcctgttggtttcccaataataatgtgaatatattggtcacatgcatggtgt

SEQ ID NO: 79826 - DNA, 320 bp, Zea mays
  Clone ID: LIB3088-044-Q1-K1-C2
gattactgttgacaaaaccattctacggaacgcacgacttaacaccatatggaagctcgtcgggtcaacctgatgcataaatgtcactgacgcttagaaggctatctggctggcgacttagttgataatggtgtgttttgccatatatagcaatggaccatttcattttatggacaattgacttctgggtggttggctatacaaaccataggtaggtctgtaatgactattctaactcgatggaccgaactattgtatgcagactactccaaactggaatcatgaataaaatgtggtactatatgctcgtagacattttc

SEQ ID NO: 79827 - DNA, 410 bp, Zea mays
  Clone ID: LIB3088-044-Q1-K1-C3
cccacgcgtccgcaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccctgaaatcacatgcccctcttgtgcacctgtccgcgcttccagaaggcaccgttgtggactcgagatagcgagagccttggacgttggacctctactcggaatttacttccagctcttgcatgtttgtggccatcatgtactgattttcccttttcaacagttgtcgtgaggctgtatcttctggagttaaaaaaaatgctaaaagccggcactaataatgatataaactttgaaaat

SEQ ID NO: 79828 - DNA, 414 bp, Zea mays
  Clone ID: LIB3088-044-Q1-K1-C4
aaaaaaaaaaaaaaaaaaaaaaaaaaaaaaataaaaaaaataaaaaaaaaaaaaaaaaaaaaagaaaaatttaaaaattaaaatagacaataatacaaaaaaaaaaaatattatataatcatacctaatttttattttacttattatttttttccatatttcttaattgttataactcttttttttaccaaacttaatttctttacaatttattccttttttaacatatttctttatattaaatatgcccttacctattacctttctcatcatttatccattttaaatatttaactatattattcttatacctttaattttaattttatatattttttttgttactctcagcttttcttttttcctttttatatccttatttttcgattttttttatttctttccttttttttt

SEQ ID NO: 79829 - DNA, 432 bp, Zea mays
  Clone ID: LIB3088-044-Q1-K1-C5
cggacgcgtgggcggacgcgtgggcggacgcgtgggcttgcctggttcctggcgctggacttctgaaccactcggtatcccctcatatcttgaactatggtcgagtagatgaagccacaaaatcgttgacgtttcccttgtctcgaccctgtgatgcaggggagcaatgctttctcagttatgggaaacatccagggtcgcatcttgatacgctctatggattcctaccaagaggagacaacccttatgatgatatacctttagatcttgacacatcccccgatgacgaggacatcgcagctcagccttcggcgactacaagccaaacaactcatatggatcgtgggacatggctgtcgacatccggaggattccccacgtatggcctgccccagcccttgctgacctatctccgtgctgctctaggctgtg

SEQ ID NO: 79830 - DNA, 334 bp, Zea mays
  Clone ID: LIB3088-044-Q1-K1-C6
tcgcgctgaccgcatagtccacagtcctcgtctttatagactctgaaatgctcgggggggaagcctaatgtataaatgacgctaacgctgaaaaggatctattgcagtgtccattagttgataaggtgtgtcttgagtcatataccaatggaccatttctttttaggaacaattgatctttaggtggttggctatagaaaccataggtatgtctgtaatgacttgtctaactgatggaccgaactattgtatgcagactactctatattggaatcagaataaagtgtagtaactatatgctcgtagatcttgttaaataaacaaggtccgacga

SEQ ID NO: 79831 - DNA, 277 bp, Zea mays
  Clone ID: LIB3088-044-Q1-K1-C7
cccacgcgtccgaacacgcgttcgcgtatcttctgaagaccggtctacttgacgctaaattcgcatggagtgtcaaacatttattaaacgcatgtggaatcaaatgaagttggactaataaagacaacaacaaaagcaaacaaaatcaataagagacatgctataagtgaaatgacaagcacatcatgatcaccatgtaagaacttacataaggacctggctgtgaatcgaaatatcgaaagccctttaagaaagaaactgtactgactatttaatg

SEQ ID NO: 79832 - DNA, 256 bp, Zea mays
  Clone ID: LIB3088-044-Q1-K1-C8
cccacgcgtccgaaaaaaaaaaaaaaaaaattaataaaaaaaataaaaaaaaagggaaaaaatataaacaaataataaatcaactaacacatatatctacaatataatccatccttaaatacactagatgcatactttatggtgttgacaataaacgcgtccagagacaacatgtagacgatcctcatttaactccacgtgcttgtgacgatcttgatctactataatctcacctagcttctgttcattgtcacta

SEQ ID NO: 79833 - DNA, 383 bp, Zea mays
  unsure at all n locations
  Clone ID: LIB3088-044-Q1-K1-B3
atggcctgcctgcacgaccacagctgcgaggatcacaactgcgccgccgactggtcgctgtacaaccacatcgacgtccccaaggtggtggctctcaacgaatcggtgcccgggagcgtcaagtccgtcttcaagccctgggagcagcgccttgacacctcggggggttttctggagagtaatgagggtgaccctgagctacttattttcatcccgttcacatcagatgttaagatcaagagcatttctgttgttggtggtgctgatggaacaagcccgtcaagaatgagagcgtttatcaatagagaaggtattgacttttccgatgctcanaacatgcagccagtgcangaatgggaaatagcagagaacctgcaaggagc

SEQ ID NO: 79834 - DNA, 351 bp, Zea mays
  Clone ID: LIB3088-041-Q1-K1-B7
ccaacgcgtaagcggatacgaccctacctttcaacgcccacttaaactgctactgctctggaaaaaaatgacactgtgccaacctgctagaaatgattacagaagcatcattcaatcccatctgaccatcgcacacctgctacgatgttgctatttactacgatgccctctagactccgcctgctaaatagtgtactgatagctacatatagaaattcagatatacggacgctactcacacgatttctatgctgtcctactcctacgaactcaacagctttctctacatcacgcactaaacaagatggctctcaatgtctccagatcatcatgtacatactaaccgatcat

SEQ ID NO: 79835 - DNA, 246 bp, Zea mays
  Clone ID: LIB3088-041-Q1-K1-B8
acggtcgctgacactatcagaagatgtgtacattacaagcagggaggtggagccagcgtttttgtgaatgataagcgtctttggtcatttgttcattcttttttttacaaaaaaaaaagagtatgtaacatgagttatacaactaggctgttcttcgagaaacaacctgtaactgtctgtcatatacttgacgaatgagaagcgttttcgtaaaaaaaaaaaaaaaaatataaaaaaatactacaa

SEQ ID NO: 79836 - DNA, 101 bp, Zea mays
  Clone ID: LIB3088-041-Q1-K1-B9
atcacccaacctccatcgcaaattcaacccaccctctatcgccacattaagcccagcatgtctaattcttacacccatccaaacctctacacttgccacat

SEQ ID NO: 79837 - DNA, 384 bp, Zea mays
  Clone ID: LIB3088-041-Q1-K1-C1
gcgcgagcgattgcggctgctgaagtaagaggttatggttcactccaacgtgtggaactcgcagcccaagaactactgtcccggatcccgcgtctgccgggtctgtgcgaaccctcatggactgatcaggaagtactggctgatgtgctgcatgcagtgcttccgcagcaacgccaaggacattggcttcatcaagtaccgctgaagtcagctgggctggctatctgaatgccatctcttggacagtgtagtataggctatgccacaattttaattactgtcatttatatgttcccttcaaaactctgctatttaagtccgccatgttttgtgatggaaaacttaagctttgtttgttatactgattatgagttacctgtgctt

SEQ ID NO: 79838 - DNA, 195 bp, Zea mays
  Clone ID: LIB3088-041-Q1-K1-C10
attcccggccgaccgcacctacctttggtatagcttgacatgccatcagtttcacagtgccgtaagttccctagaggtaaagtagatttttaacagcatggtgccattttgccagcctatgcacaaaacctcacttggtctttgtaatgtggtaatgccatgtatcactatcctagtctgatggagttttggttg

SEQ ID NO: 79839 - DNA, 207 bp, Zea mays
  unsure at all n locations
  Clone ID: LIB3088-041-Q1-K1-C11
atacggaagatctttccacgacagctgaacactacttatatcaaatgaaccaccttacgaantaggtggattcttaagctcatgggaacctacaagaacttgtacagctgatctctaaatctggtcgcagctccatactcaactacaaatgtggaaccaaaaaaataatccacttgtccaaaatcctcttaaaggcccccgaaccct

SEQ ID NO: 79840 - DNA, 437 bp, Zea mays
  Clone ID: LIB3088-041-Q1-K1-C12
acggcgggcgccctttttttttttttttttgttttttttttttttttttttttgactggaacagaagtttttaaatattccaacgcatcatccggaacatggtacccaatacaaggatcgatcagtaggagtttatgagatgaaccaaattagttaaatccgacccagcaaattcatcgatgcccttgtccgcagcgatcttgagctcgttcatcctcttcctgatgccctccccttcctcgctgccgcccatgagcctgtcgatggcggccttgatctcccctttctccagctggtccccggcgaccttcgtgcccaccttccaaacgtggcacacgtacctcgcgttgccgtactggtccccgtggctcgggtggcaaatcatgggcacgcccttcgacacggcctccacggtggaattccaaccgcaatgggtg

SEQ ID NO: 79841 - DNA, 112 bp, Zea mays
  Clone ID: LIB3088-041-Q1-K1-C3
aatttccaaaacgacccacgcgtaactaaaaaaaaataaaaaaacaaaaaaaaaaaatttaaatttaaaaaaaaaaaaaaaaaaaaaaagaaaatgtaaaattttaaaaata

SEQ ID NO: 79842 - DNA, 222 bp, Zea mays
  Clone ID: LIB3088-041-Q1-K1-C4
tcattcgtcctccatcttcctttaccatccctacactatcgccgagctgcggttacccttataccgaccctacccccctatcacattatatccccaacgtattctacattcaccacatcttccccttccttctttccactaacgtcatcatctaaatccttttatttacccttacctacattatatacctcaactacaaacatcacttatactactaacctt

SEQ ID NO: 79843 - DNA, 396 bp, Zea mays
  Clone ID: LIB3088-041-Q1-K1-C5
gcggtaggagaccacgtcgctcgatcatatcgtttgggtgaacaccaaggacgacgtggcgttgtacgctttcaagcgcatggcgtacatctacaaggctaacaccaagagcagcgatacccgctacaggtgcatctggggcaaggtcacccgcccgcacggcaactcgggcgtccaccgcgccaagttcaagtccaacctcccgcctgagtccatgtagcgcaaggtcagagtgttcatgtacccgaacagcatctaacgctaggtttttgtctaagtaaaagttgactccaaatggccatgcttatttcttctctctgagcttaaaatgccatatgttggcaacttatattgttcatgtactgaacctgctgaagttctaccaaaatttcttgt

SEQ ID NO: 79844 - DNA, 377 bp, Zea mays
  Clone ID: LIB3088-041-Q1-K1-C6
ctccatcaggcagtgggcgtccgagtacgttaacgtctactacaagtccgacgaggccgtgtccgcctaccccgagctgagggcgttctgggacgaggtgcgcaacgtggggcacggcgacaagaaggacgagccgtggtggcccgtgctggacacccgcgacagcctggtggagacgctgaccaccatcatgtgggtcacctccggccaccactcggccgtcaacttcgggcagtaccacttcgccggctacttccccaaccggccgaccaccatccggaagaacatgccggtggaggaaggcgggccgggcgaagagatggagaagttccttaagcagccggagacgacgctgctggacatgcttgccacgcaaa

SEQ ID NO: 79845 - DNA, 299 bp, Zea mays
  Clone ID: LIB3088-041-Q1-K1-C7
gcactcatacgctcaatcatacaatactactacttttacatttacatatactacaaaaactacggggccggggtacatttacaaatatctaaagccattctataactacttacacaacataaatcacaactacaataatgactaaccatcattacccatactctacaccctctacatccttatatatactcttaccaccatcatgtaactcacctctcttcaccactctatcatcaacttcatacaataccacttcacccactactttcccaaccttcctaccaccattcataagaaca

SEQ ID NO: 79846 - DNA, 441 bp, Zea mays
  Clone ID: LIB3088-041-Q1-K1-D10
acggttcgaacctactgaaaagaatgatatcataacatccacggcgtcctggctgggcatgaagagtgttctgaccggtctcacgtctctgatgggtcctgttccgatgctaaagctctacggagtcccatacttggtatttgttgcttggctagatatggtcacatacttgcaccatcatggccacgaagacaagcttccctggtaccgtggaaaggagtggagttatctgcgtggaggactgacgacgctcgaccgggactacggatggatcaacaacatccatcacgacatcggaactcatgtcatccatcacctcttccctcagatcccgcattaccatctcatcgaggcgaccgaagcagcaaagccggttcttggcaagtactacaaagagccgaagaagtcgggtgctctgccgtggcatctattccgggtgct

SEQ ID NO: 79847 - DNA, 431 bp, Zea mays
  unsure at all n locations
  Clone ID: LIB3088-041-Q1-K1-D11
acgtgcggctaccgcagttccctgccatgagagtgtcgtggccgtggccatgacgaccgccttcagcnccgtctccgcggtgacgcgcgacctcaggcttatgctgcggctggagtagccatcaggacacatagctcgtctgctggctctaacgctggcttcgatttctcttcttaattcttccttctttattagctcctactcctagtccttgtcgacgcatcatcgatcgagctgcacgttggttctggctgctctcctggtatgggtcccacgctgacgcggcgaggcttccggctcagttatattgtgcggtcggtggtgaagcacacggcggacatgggatcccaccgggaccgcagtgtagaatgataggagctgtaatacactactctgtactgtgatgtgcaagtacatagtactagttacta

SEQ ID NO: 79848 - DNA, 443 bp, Zea mays
  unsure at all n locations
  Clone ID: LIB3088-041-Q1-K1-D12
acggcgagctcnccntctangagaaggagagcttcgcctccaacgacgtctcggtcgtcagcagcnacgtctcctccggcctcgcctgccataggcccacgggcaacaagagccggctcaagggcggccggagcttgccgcgccggaagcaggtggcggcgtcggcgtctgcgtcggaccaccgcttccaggaaagatcacacaaggtgagcaagaaggggcaccagcgagtggagcaggagccgcacaaggaccgattcgacgccgtcgccgccctggacgacgacgcttgccagcctcccacggattactgagacgacctgctctgtacatagatttggaaggatttgcagggctagctgacgatttgtttgggcttgcactagtctgaaagactgcacggttactgtctgctgagtgactgtacctgtcgtgtcggtcat

SEQ ID NO: 79849 - DNA, 315 bp, Zea mays
  Clone ID: LIB3088-041-Q1-K1-D2
gcggcgggtcgagatggcggcgtcggatgttgtttaccgctgcttcgtcggcagcctcgccttgtccaggtacgaccactccctccacaacgccttcagcacctacggcgaggtcctcgagtccaagatcatcctcgatcgggagacgcagaggtcccgcggcttccgcttcgtcaccttctccacggaggaggcgatgcggaacgccatcgaaggcatgaacggcaaggagctggacggccgcaacatcaccgtcaacgaggcccagtcccgcggcggccgttgaggcagcagccgctgccggtacagtggtgg

SEQ ID NO: 79850 - DNA, 333 bp, Zea mays
  Clone ID: LIB3088-041-Q1-K1-D3
attctccgatcgaccgacgcgtactcccaggcgtcctatggagaactgaagctttttttgttatactgattatgagttacctgtagtttggttaaaataaaaaaaaaaaaaaacaaaaaaaaaaaaaaaaaaaaaaaaaaaaaaaaaaaaaaaaaaaaaaaaaaaaaaaaaaaaaaaaaaaaaaaataaaaatttaaaaaaattaaaaaaaaaaaaaataaaaataaaaaataataataatataaaataaaataaaattatcataaaaatctttaataattaattatattaatttttatataatttaaaaatattattttatattaattaatt

SEQ ID NO: 79851 - DNA, 335 bp, Zea mays
  unsure at all n locations
  Clone ID: LIB3088-041-Q1-K1-D4
attctcctgtcgacccactcgtactagcgtctctacaaaatctgttcactaccgttacggttttaccagctgcgccttttccatcggtctgttcaaacttcattgtcgctctactctctcctncattaccttttgcctctcatcttgtccacttgaaactgatccacatcttaataacataactttcttgtccaaatttaatctttcttctttcaacaatacaaggagtcatttacaacaagttttttacttttttattccttcatttttctaccttctcataacaccttctatttttaatttcccaaatttctatcttaatatcttattaccta

SEQ ID NO: 79852 - DNA, 282 bp, Zea mays
  Clone ID: LIB3088-041-Q1-K1-B5
gcactcatgcgttaaagttcaaaggaaatggcaattgagatttataccggaggcaaggatgctccgtattcgttatcttcctcgagtaggttaacaagacaaagatcatatgattcatttaactctatatcgtgtgataagttcgacatgcttacatctacattgaaagatgacggtccaaagctaccctcttccgccgaagttctcgccgcattacaagaggttgaaggacttgatgaagacacataacttgagctttatgacatcctcacctctaatgca

SEQ ID NO: 79853 - DNA, 293 bp, Zea mays
  Clone ID: LIB3088-041-Q1-K1-D5
gcggtgatatacgagtcatccagcaaatatggttgaccgacgattgatgtcgattctgttttggtctcttacctccaccacccatggagctattgtttgaggaaactgtaagcaaagagatgtcgtgggaaaggaacgtgtcgtcctccctagatctttcactttggcgaattaggaggcaggtgtgataaataagagtcttgctagttcgtcgtcgtccatgttgtcatagatcctgtcttgtgtgttcatgttactgtgatgcaggcaattgtgtgttgtgtccgggcgtt

SEQ ID NO: 79854 - DNA, 369 bp, Zea mays
  Clone ID: LIB3088-040-Q1-K1-G8
cggcgcgagccacgcgtccggccgagcagctcgagttggtcgccctccttgcctacgatgaggatgaggacgtcttctgcggcgagcaggcccccgccgccgccgccgcccttaagacagattcggtgctcaaggcgctgaacttgggctcccctaagagcggcgacgccccgcgggggttccgggagaaacccaggcactccgagaagccgaccaagtacgccggcagccccaagagcagcgctcctcgcgtgatccaccagcctcgctaggttcgctggccggcccctgatggggactaggtgactcacatggaaggctgctgcctctctagcagcatctgctactggctgcagctgccgtcggcgt

SEQ ID NO: 79855 - DNA, 147 bp, Zea mays
  Clone ID: LIB3088-040-Q1-K1-G9
tggactctccctttaactgttcatttaaccccgcttattttcttgtttcccccaacttcacccctacactttccaacccccctatccccccatacttttccctttctaccctttctttaatcccaccattcttctgtttttcccctt

SEQ ID NO: 79856 - DNA, 385 bp, Zea mays
  Clone ID: LIB3088-040-Q1-K1-H10
acgttccgaaaataaaatccatctgtttagaattcctatactagtactgactctgaggctaatgtctcattcaataattaaactcctccatctctataatacaaaaatggaacttcttaactacaaaatcctgcttaaaatccatatgcacaataaactaacactactacatatgaaacacctgctgtatatgaatcaagttatactacctatgacgaataggcttacaaacctgatatcaacatccaaacaactccaccatattttcttttcccaacaacaaaccaaacaaggcattttttcacactctatattcaatatcacatgcttgtttcttcaaaatagtatgattcaccttaatgttataaatttccccaaatactat

SEQ ID NO: 79857 - DNA, 200 bp, Zea mays
  Clone ID: LIB3088-040-Q1-K1-H11
acgccaacgcgtcggatccaatcgatggatcgttcgatctcaaacctctcgcgagtcgaatggggctccgtgctgtttttgacctgcgtaattaccaatctgcgtggcttactgaacacaaggctgccttgcttgtactgtaccttcttgaagcccaaaactgagtatatattattgatgaatgacgacatgcaaatgtc

SEQ ID NO: 79858 - DNA, 442 bp, Zea mays
  Clone ID: LIB3088-040-Q1-K1-H12
tgatggccagctggcccgtcagtgccccaagtcttatacattgggcgagaggggtggggctcctgccttccatgatgttggcgctgccttccgtggtgttggcgttcccttccgtggtggcctcagtgacgtgatctgccgggcctgcaaccagattggccatgcgagtcgtgactgcatggctggtgctttcatgatctgccacaactgtggcggccgtggccacacggcatatgagtgtccctctgtgagtctcattgagaggttcccacctcgccgtttctgaaggacgtccaagggctatccagatgactgttgttttcagcccattgtgtcaagaacactcatttccgttttcttttttttttccaaaccctaatggattctagatctttcagattcttaacttgtcagcactatttgtgattccctaatggattct

SEQ ID NO: 79859 - DNA, 158 bp, Zea mays
  unsure at all n locations
  Clone ID: LIB3088-040-Q1-K1-H9
gcgtgagagttgtagaactacctgatgaaactcacgtgttactatatgctaagatgctgtgacggtnatgtattcattgctcacttgtgttccaaagattagcccgacttgtgtgtgccatgctgacatcttttctggtttcatactcatctttacgt

SEQ ID NO: 79860 - DNA, 373 bp, Zea mays
  Clone ID: LIB3088-041-Q1-K1-A1
gcgcggacgcgtgggattcatcagtcagcaaattaaataccaaggacgattggtgaagcaattgcaattgatgcaaccttttttataacatatacaatggttgatggttgggctggggtagctggtgagatattgagattgaagccactagtgatcttccacctgaaaaactttttcttggtcaagactgagaaagacagggaagaggcaatggaccctggaagtattggttttgactcaagcgaacctcaaattcagctgtatttcttacttggtcttgtctatgcggcagtgacaccatttttgctcccttttgtattgatattctttgggtttgcgtacattgtataccgtcaccaggtaagcaagcata

SEQ ID NO: 79861 - DNA, 305 bp, Zea mays
  Clone ID: LIB3088-041-Q1-K1-A10
acgaacgatttcgagtacaattcgacttaaacttacaagaccttactcagctattgagattctgttccctttcataagagaactgtacataccaacaacggtcgctgctgttgtactaccactagtatgcaatgtggaaccaataagctttgtatgcagcgactgaaacttctacatgtgtaagactgatcagtaaagtctcgctggactctggctcattggcgcttacaactttattcatgaaaaaagatccattaactctaaaattaaaagttggccaacaacatgtttctaaagaaacaatt

SEQ ID NO: 79862 - DNA, 362 bp, Zea mays
  Clone ID: LIB3088-041-Q1-K1-A11
cgccggtcgccctccatctcgtcgccggtgcctctcgattctcttttcgataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcc

SEQ ID NO: 79863 - DNA, 366 bp, Zea mays
  unsure at all n locations
  Clone ID: LIB3088-041-Q1-K1-A2
gcagacgaagaaagccacgcgaaatccactcatgtttctgatggagtggactaatgcagtgtantagtcgacgatcaatctctgtacacccggtagaaaaagttcatgagcttcatggcagttagaatcaggattgagctgatattcatcccgcttgatgtgtagctagcattcttgtaactggaattgtgtgtgtaatgcaaatcatgggcgcattagactgtaatgaagaaaaagtcagggctgcgcctttagaatgcagcttgctcaaaaaaaaaaaataaaaaaaaaaattaaatataaaatatattaaaaaataccaataatataaataaaaactttaaaaaaaaaaaagggcggcccttt

SEQ ID NO: 79864 - DNA, 201 bp, Zea mays
  Clone ID: LIB3088-041-Q1-K1-A3
cccacgcgtccgcagtcctgcagcacgctctccaatgcgtcgtagcgtctcaccaactcggggacggagctatatcaagtcaccacaacacacaagttcacacttaaaaaaattcctatattaaaatgatatcacccgcacaacaagatctagacccatatctttatatcccacaacaagcgttatgtcacatatattgaa

SEQ ID NO: 79865 - DNA, 200 bp, Zea mays
  Clone ID: LIB3088-041-Q1-K1-A4
gcgcccacgcgtccgcccacgcgtacgcggacttgtgtttctctcagtcagctttatagctccgtgaatgtacatttatatcgctttacatttattatttatttttgtaagacttccgctatgtaataatgacataataatgacatttatgatatttgtgacatttatctctaaaaaaaatactatataaaattcaaatt

SEQ ID NO: 79866 - DNA, 110 bp, Zea mays
  Clone ID: LIB3088-041-Q1-K1-A5
actgcaattaaattctccaattaattttttagacaacgttcatctcatatttgaattcgtaaaccctggaaacatgagccatgcaaagataaaaatgagtttgttttaac

SEQ ID NO: 79867 - DNA, 272 bp, Zea mays
  Clone ID: LIB3088-041-Q1-K1-A6
cccaggcgtccgggatgaccagttttacattttctgttgctgacgaaaagaatcgatcatgttcttaattaataagcgaggaatgcaaatgtttattgtttggactagagtgaagttgcatcagaagttgatgctgaagcctgaaggcactcgaaaaatgttgcagatgcatttctacctgtatggcaatatttagggagtcgaatatctgctgtatgtcaatgagaaaatgggttttcaaaaaaaaaaaataataaaaaataaaaataaaa

SEQ ID NO: 79868 - DNA, 446 bp, Zea mays
  Clone ID: LIB3088-041-Q1-K1-A7
ggagctgggaaagaaaaggcagggaagaatttatcggaggtaaaagaatcttcgggtaaagagaagttaaacacagggagtggccacaaatcaggtcctccaaataaaattataaaaaatctggtaaaaaaagtatcatccaagattcacgaggaaaaagaaagccccaatggtagtgccaaggttttttcgagaaagaagaaacccacagcagaaaaggagatcaaagagaaaaagtcgtcaggaaaaaaggtgacaaaaggtaaaggagaatcagctgaagcagttcttcccagcaaggacgatctgaagaagaccattactgaaatcctcaagaaagttgacttcaacacggcaactttcagtgacattcttaagaagctcgacaatcactacaaaatggatctgaccccaaagaaagaagccatcaaaagtatgatccaaga

SEQ ID NO: 79869 - DNA, 166 bp, Zea mays
  Clone ID: LIB3088-041-Q1-K1-A8
acgcatggatctagtggccggtgaatcactgatcaaagagcgagcagccgccgggttgaattggtttgtttgatccctggatgtggcggctggcgaaccgcttcttcttccacaaagattcagacaaaaccgagcttggatagaactgaagaagatttggcgaacg

SEQ ID NO: 79870 - DNA, 396 bp, Zea mays
  Clone ID: LIB3088-041-Q1-K1-A9
gctccacctccaccatgttttcacctttccctccatcaccttctccttcgtccatcgcctcatttacaacttctcgagcacccccacaccaacccctaccaccttccaccataactcctccaccactactatctacctctcctccaactataacctccaccaactcctcaataaattagtgtaccttaacaagcatcgagatttactataactggacctgattctctagacctagctcgaacatcactttcacaccattcactatgccaacatccacaccctccatcaagtgctcaacctctaaaacccatatttctgtaaataattgactatccaagatcatccaccataagatctgaactctaatcctctgttctcttccatcaaatcaaatat

SEQ ID NO: 79871 - DNA, 299 bp, Zea mays
  Clone ID: LIB3088-040-Q1-K1-G12
caatctacccacgcatgcacccactcgtccacccacacgtcctcccactcttgatttaaaaaaaaaaaaaacaaaaaaaaaaaaatgtaaaattttaaaaaatctaaaacccaaaccacatctacaaaatcaatactataatactaaaataatacctatactctatcatcattcattaatcactcatacattcctctttcatcttatcccacttcaaatcaatctaataaaccaactactatccaacccaatacactcatatttaaactaattccattacaccaataatcacaattcta

SEQ ID NO: 79872 - DNA, 361 bp, Zea mays
  Clone ID: LIB3088-041-Q1-K1-B10
gcagatccccacctgatccgccttttgctttctcattactcccctctgcagacagtatgagataatttccaaatgctccggggcacacacaattcaagcagcaacattacttccagaacttgaccaagcacacctacctgaaagggcgcttcgacatgatcaccttcgtcaccatcccccttgcactagctgactacatcatgctcatgattggacgtggagtttacaacatgtatcatggcgttgggaagaaagagcgatcttccactggttaactattgcttctgcttggcattgaattcataccgtcaatactgctaaatcctcttccctagcaaaataatactggcaaataacaatt

SEQ ID NO: 79873 - DNA, 137 bp, Zea mays
  Clone ID: LIB3088-041-Q1-K1-B12
acgggaggcggaagtcaatttttgttttttggtttgtgtgtgtgaatgccgtctgtggcatcagttccttttaactgtcctctatccttctctgattattaaataccctgtctgtcactgcatcagtggcaaccgtt

SEQ ID NO: 79874 - DNA, 408 bp, Zea mays
  Clone ID: LIB3088-041-Q1-K1-B3
gcgcccagcgcgtccgatagacgtccatccgacttagccatggatggtcatcactcaagctaacgagttggttcatgtttgggactaccatacaaaggtagtggaatggacgattcagattaagggagcgaaagttagttcagctaaatttatagccagccaggattggattgtggcgggtactacccgtggattcctccacgtgtacgattgcgaatcgaggaaggaaatacgccgtctttgtgaacacccgaaatctatcacgtctttggctgttgacgatgatgcccttgagctggtgctgtcagcgtccatcgatggcaagattttgatctggaactactggcactactaccgcgcacgtagaggtagacgtagtacctggcatttggaaaaaacattttgacg

SEQ ID NO: 79875 - DNA, 457 bp, Zea mays
  unsure at all n locations
  Clone ID: LIB3088-041-Q1-K1-B4
acggttcgtggtggatgcaggccttggtacccttaaaatttgtatgcaagatgagcttacagtgctncgcgttcaatctagcgaccaggtttgagaataaggtgggattcaagaatgtagtggctggtgaatcactgatcaaaaagcggatttttgagagattcttcatcgatctagtggccggtgaatcactgatcaaagagcgagcaaccgccgggtttaatgattttgtgggatccctggatgtagcggctggcgaaccgcttcttctttcacaaagattcagacaaaaccgaacttggattgaactgaagaagattttgccaacgaagaaaaaggtaaaaaggtttcaaattaataaaatattaatgaggttatttattaaccatttcaggttttataacttttctttcatttcaaagcttaaaaaaaaataaaaatggctggcccctttttt

SEQ ID NO: 79876 - DNA, 315 bp, Zea mays
  Clone ID: LIB3088-040-Q1-K1-A11
tacgtaaaaattggcatccaatttagcattatagacacttaaaaaataaaaagaaaaaagtaaaattaaaaaaaaaaaaagtacaaaaaaaaaaaaaaaaaaaaaaacaaaaaaaaaaaaaaaaaacaaaacacaataaaataaaatgattaactaaacacatacttacaaagaacaaaatcaaaatataatactataactcgaaataaacaaatcacaacatatattaaaacttcataacttgtaaaaaattaaaaatccaaaaaaaaaaactactacaataaaaatcatgttaaaaaaacttacaaaaaataa

SEQ ID NO: 79877 - DNA, 285 bp, Zea mays
  Clone ID: LIB3088-040-Q1-K1-A5
gaggcgaaggactacgtacaaggtcactttcacaggcttctataagcttgacgccaaagtctgcatccagatacgtgctgccgaatttgaaggtttcaaccccaaggcagaactctgaaacggttttaattgttcttaaacttgataagtctatgcgatatacttttgtacaaaatcgtctaatcaataaagtgggcacgtgcctaaggaccctaccctactttgtctgtatgtacatctactgtcacacttaaacagtacctgcagctatgcggtgttttgggc

SEQ ID NO: 79878 - DNA, 195 bp, Zea mays
  unsure at all n locations
  Clone ID: LIB3088-040-Q1-K1-A9
cccacgcgtccgcggacgcgtgggcgtgattttgcttgaccatattactattagtccatagatnaatgtatnatattcaacttcaaccttaattaacttaacaattatatctagatgtcattcaaacaaagttcacaatattgaagaaatgattctctcaatggatgctcaataagatgtgactcaagaatggct

SEQ ID NO: 79879 - DNA, 291 bp, Zea mays
  Clone ID: LIB3088-040-Q1-K1-B1
cacgcatccggcgatgcatgttcatgaagcatatttgagacgctgcggctgggcaaaccaggtatcgtggatatttacaaggatctgatgcacaatcaccagagcgaactagcagaataattggctgaaaggaagcacctcttctgcacacgcccacaaacactgagatagaccatccgggcaatggacctggagacgctgagtccttacgagccatgggatgccaagccagtcgtcgccctgatcaacaggtttcttggcttcccaattgtctgacaaataaacgacgag

SEQ ID NO: 79880 - DNA, 297 bp, Zea mays
  unsure at all n locations
  Clone ID: LIB3088-040-Q1-K1-B12
gcgcccagacntccggtggcaacggatgacacttatattttaggtgaactttataagctcaatgtttccgtcctatatctattgaaactagcatccaaagaggaacagggtgattatgtcggtgcatggtacagtatgcttctgtcctgtgctcaagaattgaagcatggcgtggcactttggcaagagttttatcatgcaaatgtctgcgacagagtagtttctgaaagcggtcactactttattgctcttggggagatatatagagttgcacagattttatacttatcctttcaa

SEQ ID NO: 79881 - DNA, 272 bp, Zea mays
  Clone ID: LIB3088-040-Q1-K1-B5
gtgaacaagtgtttagcttaactgattgatgattacagcatggttaagttcatttgacatgatttgagacccgaaagcatcatacaatatgtgctatcttctatctacacatgtatccagtatggtgaatattcatactttaaggtcaggtacttctaataatactaatactaaccactggatgctattgtaagtgcaaactggttgccaacattcatatatggcggagtgagacttttttactgtatggcgcaagcattcaaaaacctcct

SEQ ID NO: 79882 - DNA, 71 bp, Zea mays
  Clone ID: LIB3088-040-Q1-K1-B6
aaaaaggaaaacaaaaaaaaaagtttttaaaattaaaaaaaacaaaaaaaaaacaaccgccttgtaaaagt

SEQ ID NO: 79883 - DNA, 283 bp, Zea mays
  Clone ID: LIB3088-040-Q1-K1-C1
cacgcatccggggaggtatagagacatcttacctgacgctagagtacggcatgaccgatcgcatcaacgacaagtttcaaatggagaaggtacatacagaggtgaggacgacgatgcgctcgccggacggcaagaagcttgacatactatctgatgatgacctctgcagcatgccctacctcaaggcgaccatcaaggagacgctacacctgcacccgtcagcaccgttcctactcccgcactactccaccgtcgactccgagatcgactgctacttcgtccc

SEQ ID NO: 79884 - DNA, 117 bp, Zea mays
  Clone ID: LIB3088-040-Q1-K1-C10
atcttttaaggttaacctttataataacaaacatagtatttttggttataattaatgaaacatttatttaaaaacaatctatataaatcaattttactaatcacatacaatcaatat

SEQ ID NO: 79885 - DNA, 363 bp, Zea mays
  Clone ID: LIB3088-040-Q1-K1-C11
attgatccttccaatctaactgtgctttgcattgataagattatgttcaaatttaaaggagctcagtccctccagagcatctgccatctgaataattctcaatagaatggaatggttgtgccttaatgttccttgccatggttaattttcctttatacatcttgccataatgtccacattctaagggaccactgtcacctggaaaccttttccaatactttttccccattcaatgtacatatttccatcccttggtgttttagctgttctcatcaaatctaaactgaatcttggtacattggtgtatccttaatttaaacactgcaattttaaaaagatttttccccttttaaattttttgct

SEQ ID NO: 79886 - DNA, 243 bp, Zea mays
  Clone ID: LIB3088-040-Q1-K1-C12
tattttatttttaattttttttttattattcttttaactgaaacaagttattttaaaaattccacagccccatcaaaaacatttaacccaaaacaaatatcaatcaatattaatttataaaaataaccaaattatttaaatccaacccatcatattcatcaatacccttatacaaaaacatcttaaactcaacaatcctatttctaaaccccttcccttactctttaccaaccataaacctaa

SEQ ID NO: 79887 - DNA, 110 bp, Zea mays
  unsure at all n locations
  Clone ID: LIB3088-040-Q1-K1-C3
ctctanggaccgatagaacattgagccatcccatccaccaaaggtattctgccaatttttaaagcatagaacccctaccatattctttaatttgtacgctcaaatatact

SEQ ID NO: 79888 - DNA, 126 bp, Zea mays
  unsure at all n locations
  Clone ID: LIB3088-040-Q1-K1-C6
taaaacgaaccaatacatggagattgtctattatacactatgtacatctttaagtcttatgttaacatttacatagccctatcatacaaccnncgggggaggggtaaccggcatgcctattctaaa

SEQ ID NO: 79889 - DNA, 208 bp, Zea mays
  Clone ID: LIB3088-040-Q1-K1-D10
ttactgtcttcttattcatatcacgacccaggttattttaaatattccaaatctccatcacagatcagaacccatttctacaataattacctaccaattgccttttagaaaccatttaaaaacaatcctcaccctctaacacataaattcactaaaaaacataaatctttaactcaataaatcctataaaaaattccctccccttaca

SEQ ID NO: 79890 - DNA, 253 bp, Zea mays
  unsure at all n locations
  Clone ID: LIB3088-040-Q1-K1-D2
cactgcttcggtgcccttctggctgnctgggggnnatggacctactataaatactccaacatctgcactgcgctggtccggaactgcctcaaggagcccttcaagtctgatgccgaatacctcgagaaggttcatttctccatttccaagtgtacggatggcaagcatgagaagccaactgtccgcacagaaatcgatgactaagggctggcgcaccatggcgacatagtccttcctacagatgatttgaagc

SEQ ID NO: 79891 - DNA, 252 bp, Zea mays
  Clone ID: LIB3088-040-Q1-K1-D9
acgttcaaagcctatcacaatttctttaacttcataactctgaaggccatgtaaatacttatatgttatctgaccttcaacaactttgtcaacaactctttcaatctattcccaaccttatacttaacaacaaatctaagaccaaactgactatccatctttactcaatccacataaatctccccgctatccttcacgacccttacaacctaacctcttatatcgctaatagacacacctctactaatatca

SEQ ID NO: 79892 - DNA, 352 bp, Zea mays
  unsure at all n locations
  Clone ID: LIB3088-040-Q1-K1-A10
nccaggcgtccgttaccattctgatgacagtcatgtttcctctgttaatgacgataagatgatccggtctgcatcatatgttcttttctaccgacaagttcgacgttcaagtacagcggcaaacggtcgtccagctgacattgaaatggtcgattcactagagacatatttccccagatcaaagcctgactataatatgtgaatcgagatattgagatcataccagttatggacattacatgtctgctacgaaatggaatatctgtgtatgaaacctttgacatttcgaggcatgtcagacaccttaggacctaatagcgtaatctcttgaatctgcacatctatatgattg

SEQ ID NO: 79893 - DNA, 355 bp, Zea mays
  Clone ID: LIB3088-040-Q1-K1-E10
acgctaagtttgagtcctaactaatatttaagtttagctttccatcatcacttgctgaactggtctatgatttacatttataattgaagtctctcactttaatcaaaaaaaaaaaaaaaaaaaaaaaaaaaaaaaaaaaaaaaaaaaaaaaaaaaaaaaaaaaaaaaaaaaaccaaaaaaaaaaaaaaaaaatgccaccctttttaaaaaacccaacttaactaacccttccatccaacttaaaactttttttatatctacccctaaattaaattaaatgcccctaatttaaaaacattataattgaaaaaaccttattttaccaaaattaataccccttaaaaaaaaccccctt

SEQ ID NO: 79894 - DNA, 366 bp, Zea mays
  Clone ID: LIB3088-040-Q1-K1-E12
gagggaagagatggcggcgtcggacgttgtttacctttgcttcgttggcggcctcgcctgggccagcgactaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcccgcggcagccgtggaggctgcggttgcggatacggtggcgggcgccgtgatggaggctgctacggcggttgcggtggaggctacggcggtggtcgtgg

SEQ ID NO: 79895 - DNA, 228 bp, Zea mays
  Clone ID: LIB3088-040-Q1-K1-F11
actcagccaatgaagtttgcatctctgcctaactgaggtcacccaccgataaactgagagacttgctgcgcaaatgatcctcctaaaagcaacctgcacctctatctgatgattgaactcataggctcagaataattacataactttgtaactgttagcactttaccgttaaacaatgtcattgtcaccatccatatgttgattgtttgctcgcttgaatgtattaag

SEQ ID NO: 79896 - DNA, 348 bp, Zea mays
  Clone ID: LIB3088-040-Q1-K1-F12
acttgttatctctgtatccatccgggtttactttgacatacttcttgccgtctcaaagacacgttctactcatgccacacaagacaacttcaacaaggtatcaatcttcccgcccttcaccaacattagaaagatctctgcgcacattgccgcaaccatgactgcaaaagcttatgaactccgattgtcgacccgtctgccttccccaatggacctggtgaaatatgcacagagctgcatgtacactcctgtctaccgtaactaccggtagtgctgctgcgatcaattctgcactaataaaatatgtcgacgcacatgaaccttcaatgttgtactttattttttcat

SEQ ID NO: 79897 - DNA, 113 bp, Zea mays
  Clone ID: LIB3088-040-Q1-K1-F6
tcttccatgttgtgttcatagctctcttcataccgtgtggtaaagatacttttatataatcccatttcattccctatcattctcatacccgttcaagattatccaatcaccac

SEQ ID NO: 79898 - DNA, 390 bp, Zea mays
  Clone ID: LIB3088-040-Q1-K1-F9
atttcgggtcgaggacgcgtgcggcagcttctgcttgctctggggggaaggatttagagtgagagcgagagagagatctagtagagagggtagtatgtggtcgtcgaacgagacatgttggcggtgttcagcgggcaggtggtggaggtgccggcggagctggtggcggctgtcagccggacgccgtcgcccaagacgaatgcgtcgcatctggtggggcgcttcctggccgcgtccgaaccggtcgtgttcgtgcagcttggcgaccaccggcacctcgtctactcccacaccaaccatgcgctccttcgtcccatgtcgttcgcggtcaaggacgatgtgttctgccttgtcgagggggtgctggacaaccttggtcgtttgatccag

SEQ ID NO: 79899 - DNA, 279 bp, Zea mays
  Clone ID: LIB3088-040-Q1-K1-G11
gttgctagtagaaagctagcactgcccttttggtaacggcgtttcaggagtactgtcctggactatgtagagagatgctcctctgtgactgtgaccacctcacgttctgcgtactgtaatctggtaggatgcctgtctctatcatgattcatgaaggacgattggtttgtctttcttcttatcgtgctgtttattaatcgtgtaaatgtaatactagcgaacggaaggcactggtagctaggttagctcgagtccggattgaatgagaatgctactaat

SEQ ID NO: 79900 - DNA, 310 bp, Zea mays
  Clone ID: LIB3088-010-Q1-K1-H10
catgggagcacgcatacgccgccctaggccaggtgaccagcttttggccgggcccaggggtggcgacgagaatccaatagtgaagctttctatgtgttggcagataaactgagcagtgaggggtcttgacggtagcagagtaggtcctggctgtgttggaaggtaaactaaacagtgaggggtcctgacgtctgcaaagagcactgagaaaaggcacatgaggggcagtaagaggacagcaagtcctactgttgttggaaaataaattgagcaagtgctggtggcggctatagaaaaaggcacgaggggt

SEQ ID NO: 79901 - DNA, 177 bp, Zea mays
  unsure at all n locations
  Clone ID: LIB3088-010-Q1-K1-H11
caccactccacagcactatcaagagtgtatagaacanagcatacagcaccgcccaccgtttgtttattttatgatgagtgaggtacaaacctacctattactatatatgcttccaaaagacacgtcttatcttcactgatatactaagtattattttataaattatattgacttcct

SEQ ID NO: 79902 - DNA, 307 bp, Zea mays
  Clone ID: LIB3088-010-Q1-K1-H12
gtcagcatctgcgccaggcaaaggtggcggtgtgcttgatcggccagtataaaaaagtacgcctgttcgtcagtgcgaatttgatgtgaagaaatcccgcaaaatgacgcctccattccgcgtcatccttcacaatgacaaccacaacaggcgtgagtatgttgtccaggtcctgatgaaagtgatccctgggatgaccgtccacaacccgttgaacatcatgcatgaagcgcatgtgaatcggttgtcagtggtgattgtctgttcccagtcctaggcttaagagcacttcacgttacttaagggc

SEQ ID NO: 79903 - DNA, 121 bp, Zea mays
  unsure at all n locations
  Clone ID: LIB3088-010-Q1-K1-H2
tccaagacctaccttcatttttcccacaccatccncaataacggctacggtcgcttctaaaaacgtccctgcacngtacaataattctccacttccaagactgctaatcatggccattcca

SEQ ID NO: 79904 - DNA, 429 bp, Zea mays
  unsure at all n locations
  Clone ID: LIB3088-010-Q1-K1-H3
atcgaaggccanaagtggtccgcgatgacggggcagctaccgtgcaaactgtcagagtcggttggtgaatcagggtggagactgaagaacagcagggcatcaccctttaccggtttaactgcatatccgtttcttgcacaatcagaccaagtgtcgtccttgggttgcaataacttcccctctgcattggggaagatggtctctccacccttctcgacatttgataggtacatcagcacagtggcaatgcgatggccgcccagggcctgattatttttgtcatggaagtagtcgtagtggggttcatatttctcaccattctggtagtgtaatatctgaatggcttcaccattctctggtggaagaaatgtccaagcaaatatcctctcctctatttctcgtactacttcatcctgcttcttctcgcta

SEQ ID NO: 79905 - DNA, 359 bp, Zea mays
  Clone ID: LIB3088-010-Q1-K1-H4
cgcggcggcgccctttttttttttttttttttttttagccctcaacattgcaagttgtgtggatgaacttctataacacttcacaatctgatagtcacttgctatccattgaaatcgctctacaaggttcctctctgatagtcacttgctatccattgaaatggctctataaggctcctctcttggtggcctctgttttcttggttatggtagtaccaacctagttggaggtgcggtacagtttcccaaaaacatggagcatagcgacaacagctatgaacccaatgctcatgatcagaaaagtgtttggtgacattttgcggcccgcagcctcatcggtgtagaactggagcatcgag

SEQ ID NO: 79906 - DNA, 325 bp, Zea mays
  unsure at all n locations
  Clone ID: LIB3088-010-Q1-K1-H5
gcacgcgtgcggcnncncccttttttttttcttgattttttttagccctcaacattgcaagttgtcgggaggaacttctataacacttgacaatctgatagtcacttgctatccattgaaatcgctctacaaggttcctctctgatagtcacttgctatccattgaaatggctctataaggctcctctcttggtggcctctgttttcttggttatggtagtaccaacctagttggaggtgcggtacagtttcccaaaaacatggagcataacgacaacagctatgaacccaatgctcatgatcagaaaagtgtttggtgacattt

SEQ ID NO: 79907 - DNA, 181 bp, Zea mays
  Clone ID: LIB3088-010-Q1-K1-H6
ccctgtctcagctcaaccgtatgtaccattgcccgttggtgtcgttttagtgcctaacagggttgatgaattttgtgatgagttagctactgtcctgccgatgactatgtttgcttccaaaggacacggcttatcgtcgctgatatactaggtattatgttataaatcacatggactgcct

SEQ ID NO: 79908 - DNA, 418 bp, Zea mays
  unsure at all n locations
  Clone ID: LIB3088-011-Q1-K1-A1
atttttggtatatacacatgcttttactagtagaggagtatttattttcatttgtagcagccaaggaacttgtgcattccttatgaatcatgagaagaccatgaagatgcacacaaatttgcttgacttctgaccagtaataattagcgaaagaaagaaaatccagaaccatgaatcagcttgatagcagtaacaaatttgcttgacttctgacgagtaagaaattggcagcaagttcagcaggggccagactaataaatcagcttgatagcatccttgcagcggtgccttggactttggcggttagaagaggtttataattntatatgatgaaattatgtgcatcttcagttgtttttgcctcactgctctttgcggctctggataaactcgaagctgacctatccaagttcgacga

SEQ ID NO: 79909 - DNA, 252 bp, Zea mays
  Clone ID: LIB3088-011-Q1-K1-A2
agacaaaatgactgcaggttccgttttgaataaaaggattcgttcatgaaaaacggaacgctgcagtcattttgtctgaggcgcttaaggaggcccgtgcattcaggaccgaagccttctgatgtacccatctagccctagagatcagactatttatacacgcaatgttcaagttcttttcttttaaaaaattgtccaaaatatgtgactgtacaataagctaaaatcgcactatgtggactatatattagt

SEQ ID NO: 79910 - DNA, 126 bp, Zea mays
  Clone ID: LIB3088-011-Q1-K1-A4
aaaaaaaaaaaaaaaaaaaaaaaaaaaaattaaaaaaaattaaaaaaaaaaaaaaaaacgagcagaaatagacataaaatacatacatacacatgcatactacagaaatatataatatatagagct

SEQ ID NO: 79911 - DNA, 318 bp, Zea mays
  Clone ID: LIB3088-011-Q1-K1-A5
ccagatggaggacctttctattatacatttgcatattacacatactgcggtgtatcgggcataagtgaggtgcgtgtcgaaggactggaaactatggactaccttgacaacttaaaggcataggaacgtttcacagagcaaggcaatactaatggttttgaatcagaagttgacatagtttaccttgctgcaccctccaaaattgctatcattgatcatgagaagaaaagaacatttgtcgtgacataagaagggcttcctgatgcttgtgtttggaacccttgttacaagaaggcaaaagctatgcaagattttggg

SEQ ID NO: 79912 - DNA, 398 bp, Zea mays
  Clone ID: LIB3088-011-Q1-K1-A6
cacgcgtacgaccagatggaagacctttcttttatacatttgcatattacacatacttcggtggatctgacataagtgaggtgcgtgtcgaaggactgtaaactattgactaccttgacaactcataggcaaaggaacttttcacagagcatggcaatgctattgtctttgaatcataagttgacaaagtttacctagctgcactcttcaaaattgctatcatcgatcatgatacgaaaagaacatttgtcgtgacaaacgaagggcttcctgatgctgttgtttggaacccttgggacaagaacgcagaagcaatgcatgatttcgtggatgcacaatacattagcatgctgagtagtatagcctgcatctgttgagaggtctattactcttgaaac

SEQ ID NO: 79913 - DNA, 385 bp, Zea mays
  Clone ID: LIB3088-011-Q1-K1-A7
tgaagatatgaataaccgcgagccgaggttgatgaagtgtgtgctgataataaatatggatgtcaaagataaccatgaagaagctggtgttggggcaaagcttgctgtagagttgtgccagaagcttgaagcaattgatggtgactgggaggacataattgatgacttgattactgcatttgagaagcagcacaagcggagacttgcatacagcatttcattctactaacttgtatagtcccgtttggacagagatgttgcagtggatggttggtaacttggcattgtagtaagcaactgcatatgagtgaagcatcatgtcgtggcagtgttgcttgaattcttccacgcttacatttgcctgtgctagcctgttttttaaaaa

SEQ ID NO: 79914 - DNA, 325 bp, Zea mays
  Clone ID: LIB3088-011-Q1-K1-A8
aaaaaaaaaaaaaaaaaaaaaaaaaaaaataaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaataaaaaaaaaaaaaaggggccccttttgcaatttatttttaaattgtaagcggccgttttaaagattcaaatttttggaacgcttttttgaaacgtaataatttttatattggggcccttaattaaaataaatgggccgtgttttaaaaacgtttttaactggaaaaaccttggcgtaaccaactttaatggttt

SEQ ID NO: 79915 - DNA, 446 bp, Zea mays
  Clone ID: LIB3088-011-Q1-K1-B2
cgcgccacgcgcgcgcccacctcgtcttcccaaacaagaaggctacgtgtcccgcgcggcggcggcggcggcctcggtcctccctgccagagcgcgtcacgccgccgctgctaccgacggttaccgtggcagcgcagctcgtgcgctgaagcgccgtcaagccgctcctcctccttcacgtggcttgccgtcccggcgctaccgccagtgcagagcgcacccgtgctgccatggcgtggagcccaggtcgtgccgtcacgggcacggctgctgccgccaccacggcaagccggagtgcagcagctgccgagggtactgctgcaggcccagagcgcaggagccggccgccaaggacaccaagcggcgcctggcgccccggaaccactgccggccggtgctcaagggcgcgccgttcatcgtctgctccagctgcttcaagctggtgc

SEQ ID NO: 79916 - DNA, 422 bp, Zea mays
  Clone ID: LIB3088-011-Q1-K1-B3
cccacgcgtccgcggacgcgtggggtcaaggaactcagggttttctactcaggttgtagagttggacgtcctgtaccctagcgaaggcatccatcggcgatgggagagtggttacaggataacttccacagcggccaccaatgaccaagctgctttcatcttgagcatgccgaagcgcaagccgatggacgagacgcaagaaacccttcggacctctgcctttcccagttcacatgtcaaggagaaatgggcgaagaatctctacatagcttcgatctgctacggacgaaccgtgtgctgatagtcgaagagaggggcggccccactgactgagtacggtggcttgcgtcaagagattagagatgtgagatgaacatttaatcaaaatcagctctaatgatgataggatcagttgatctgaa

SEQ ID NO: 79917 - DNA, 241 bp, Zea mays
  Clone ID: LIB3088-010-Q1-K1-H1
gacccaggcgtacgtttttcaactacttaaccatgaggcccatgattctttgttcatctcggatcaaactacctgatttgtttccaacaatggtgtctgggcccaacaatatttacctttttaaatcactaccaatccacctcactaggccttttctgtaacatcatacacgacccttacgatttcaaaacatatcaccatttatcaacaaaaacaacttattatattttgtgggccatct

SEQ ID NO: 79918 - DNA, 428 bp, Zea mays
  Clone ID: LIB3088-011-Q1-K1-B4
ggccgcccttttttttttttttttttttttgtttgaaattttggatgaactgaaccaagtcttcctgtacaggttggtgctgctacatgcagttatttttgtcacaggttttcccctcatctcccgagctaagaccgctcatccctggacacaacgcaacacagtgtcgagggggatcgtgaggcgagagccggccggagactcagtcctcgaccggtcgtggtggtgttcgcatcggcagatcagaaggaaaaccaaaagaatataagaccgagagctcttggagccgtcgtcgatctagtcggaggccttctcgacgatgctctcgagccgcggccttcacacgccgacgcgggcgccgctgcgccggcttcagtggccgccgtctgacgcggccttttcggagagcagctccctcaagtagttgt

SEQ ID NO: 79919 - DNA, 350 bp, Zea mays
  Clone ID: LIB3088-010-Q1-K1-F11
gctgctcatggtgtatccatatgttgcgttcggataccccaacctgaagagcgtgagggggttgatctacaagagaggttacgggaagctgaacaagcagaggattccacttagcaacaacagtgtcatcgaggagggcctcgggaagcacaatatcatctgcattgaggaccttgtccacgagatcatgactgtgggcccgcacttcaaggaggctaacaacttcctctggccgttcaagctgaaggcacccctcgtcggtctcaagaagaagaggaaccactacttatagggcggtgacgcctgaaaccgtgagaactacatcaacgagctcatcaagaggatgaact

SEQ ID NO: 79920 - DNA, 295 bp, Zea mays
  Clone ID: LIB3088-010-Q1-K1-F12
cgtagtcaaaatgaaccgtttgttgttttggttcagatacgatgatgtttcgtttgtaggttcgacgttggttgctgaactcgtaacattttattgtcggtattatgtaaaaaaaaaaaaaaaaaaaaaaaaaaaaaaaaaaaaaaaaaaaaaaaaaaaaaaaaaaaaaaaactaaaaaaaaaaaaaaaaaaacaacaaactaaatcaacaaaaaaaaaatataattaaaaacaaataaattaaataggggggaggctttttaagataccaaatttaaaaaaaacgcgtacgcaa

SEQ ID NO: 79921 - DNA, 358 bp, Zea mays
  unsure at all n locations
  Clone ID: LIB3088-010-Q1-K1-F2
gcgttcccataccctacctccaaattcccaattgtttacctctcctcagaattcnaatgaccatgtgtgggctctgaaagggcgggaaggggctaagcaagggcggcgcgaagcgtcaccgcaaggtcctccgcgacaacatccagggcattacgaagccggcgatccggaggctggcgagaaggggcggcgtgaagcgcatctcggggctcatctacgaggagacccgcggcgtgctcaagatcttcctcgagaatgtcattcgcgacgctgtcacctacacggagcacgcccgccgtaagaccgtcaccgccatggacgtcgtctacgcgctcaagcggcaaggccgcaccctcta

SEQ ID NO: 79922 - DNA, 361 bp, Zea mays
  unsure at all n locations
  Clone ID: LIB3088-010-Q1-K1-F3
gtacggatggccacctcataacaccaggcacgtcatggagaagctacaggcgggggtgaggacgacgatgcgctcgccggacggcaagaagctggacatgctagccggaggaggacctcggcagcatgccctacctcaaggcgaccatcaaggagacgctgcgcctgcacccgccggcgccgttcctcctcccgcactactccaccgccgactccgagatcgacggctacttcgtcccagccgggacgcgcgtcctcgtcaacgcctgggcgctcgggagggaccgcacgacgtgggagaagccggaggagttcatgccggagcggttcgtgcaggaacccggcgccgtggacgtncacat

SEQ ID NO: 79923 - DNA, 138 bp, Zea mays
  Clone ID: LIB3088-010-Q1-K1-F4
cactggcgtcgctccagatgtgtgtgagttgagatagtgggttggattggatttggctggtaggtagcgtgtgtatggcatgttgctgaatcaaatgatgtgatcatcgcaaggtcacaaacagcctctttgtcatgt

SEQ ID NO: 79924 - DNA, 399 bp, Zea mays
  Clone ID: LIB3088-010-Q1-K1-F6
acaaaatctgcaccagaaccaaatttgtttcggcacaatgtagcctgcactgctgagcgtgatgggtacctgtactcactgaatgcttccactcttagcaaacagtgggaatctatggggccctttctacaaaagaccgtggcatcctttcgccttctccccggtacagaaaactatgttcctccctacaaggatccttggagattttggtgaatggagattcttcttgtagtcatcatttttatcccttcagatgactttatagcttcaggttttagaccatatttttcacgtcagatgtttagtgagtgtctgtcctttcagcttgacagataaaattcagagacccagtttggtatcagtttcgcccatcgtgttcgttctgattaataacagtcc

SEQ ID NO: 79925 - DNA, 333 bp, Zea mays
  Clone ID: LIB3088-010-Q1-K1-F7
ccataccctacctccaaattcccaattgtcaacctctcctcagagttcgagtgaccatgggggggcgcggaaagggcgggaaggggctgggcaagggcggcgcgaagcgtcaccgcaaggtcctccgcgacaacatccagggcattacgaagccggcgatccggaggctggcgagaaggggcggcgtgaagcgcatctcggggctcatctacgaggagacccgcggcgtgctcaagatcttcctcgagaatgtcattcgcgacgctgtcacctacacggagcacgcccgccgtaagaccgtcaccgccatggacgtcgtctacgcgctcaagc

SEQ ID NO: 79926 - DNA, 291 bp, Zea mays
  unsure at all n locations
  Clone ID: LIB3088-010-Q1-K1-F8
cngacccctaggcngacacttgggtttttattcattagtttgtcccttgatatccgatggttttaagaaaatggtgtgttaatctgcttttccacaggcttaatgctatctggacgaggtccttttatgaatcttgatttggatgctcagctctttcatacgtctactcctaatcaaaatcccatcacatttcatgttattggtagacctcttgaaaactctggtgtttaatcagtatgtcactgcggataacgctgtcaaaagtaaaaaatacacaatgtttaaagaaat

SEQ ID NO: 79927 - DNA, 280 bp, Zea mays
  unsure at all n locations
  Clone ID: LIB3088-010-Q1-K1-F9
ctagccgccatatctcacgatccactcgttcaccaagccgagggaaggtgaggagcgatggcgcgctgcgtggtgtcggcgaanggctacaccatcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtca

SEQ ID NO: 79928 - DNA, 214 bp, Zea mays
  Clone ID: LIB3088-010-Q1-K1-G1
caacaccaccaactccctgccgggactcctgctcgccctctgatcactctgagggataaattaaataccatctctatctatatactacgtatcatccttgtcgtccgcagtcattcagtgcaaccgtgtgtatgtatgtatctacgtacgtattgtatttctatcccatccatggccgtatgtcacttattatatatatacaacatatctcatc

SEQ ID NO: 79929 - DNA, 383 bp, Zea mays
  Clone ID: LIB3088-010-Q1-K1-G10
atcgactgggaagaggttggaaagcagcttgagctggaaggcgtggactccttcgagaagagctttgacagcctactcgtgagcctgcaggagaagggcaacagcctcaagatggcgagtgtgtaaagctgagaagattgggtacctgcgagtgaacgattttactaaataaaatgctagcttgctggctctcctcttagtttttacgctgtacctttgctctcaattttctgaatcggctttgtatcccaggcttgccagaacgtcattgtgtagccactgttcatggcttgtaattgctacggggtatccgataacgtcattgtggatgatgcctgtttgccctgactcttgaactcaatgtcgccatgtggtttctatgc

SEQ ID NO: 79930 - DNA, 425 bp, Zea mays
  Clone ID: LIB3088-010-Q1-K1-G11
gtaagcatagattctagagaatatatataggaaaaacgtatgcaaaaaatattcgagttgctgcatgctttactttttgtggacctggaaggcatgtctttgtataaagttgaagtaccttgaagtgctgctaactggaaggcttcagagaccttattttcttcacagcatccaagacaatgttcatttcatttcaaccccaccattactcctttcctatcataaagaaccatgtgttcccatgaatagatgtgacacaactcacaaaatatcagtaaagccatactacagaacgagaactgttaggatagtgattacatgcttgagaaatgcaatgtcaacataaagagcttgacacgagatcgattgtcgaggcaccatctattgggactgctatacccaaaaggtggatcaatgccaacata

SEQ ID NO: 79931 - DNA, 385 bp, Zea mays
  Clone ID: LIB3088-010-Q1-K1-G12
cagggcacacgcactacacgcacggcacgcagatacatatagagagaggttagctgtggcgggcacatctatttaactaactaactaactggctagctagctcgatccgcagagcaaagcgaaagcagcaagaagcaaagcaatggagaaccctgcgagtgtgctagttctaccagcgcagttcaccaaactcaccttcggaaacctgtacatccgccgggccgggccgggcagcagggagataaccgaggagggcaggtgcgacctggacaggagatacgtgagtaacttccccgtctacgacggccgcggccccgacgccagccttgtggcccgcgtgcaggggatcaccaacgaaatcgggaacgcgcaccaactgttcgtc

SEQ ID NO: 79932 - DNA, 278 bp, Zea mays
  Clone ID: LIB3088-010-Q1-K1-G3
cccacgcgtccgcacgcctagtttctctgtcgattcctattcgtcgtctcttcagggctggtgcgcactgctgcgccgttctgttaaccgaaacaagaactctgtgtattcctgtaccgagctgtgcatgttttttttttctttccatcgtggagaatttaagttattatccgtttgctgcaaggtttgccgtctcattttatgcgttgggatgttggcaagaaagggcagatgtcatgtgagaatttaagttaagtgaaatcgattcagggttttct

SEQ ID NO: 79933 - DNA, 76 bp, Zea mays
  Clone ID: LIB3088-010-Q1-K1-G4
accactcgtacgaagggtaaaaaaaaaatttaattaaaaaaaaaaaaatatacaaaacggggagggtttctatcgg

SEQ ID NO: 79934 - DNA, 413 bp, Zea mays
  Clone ID: LIB3088-010-Q1-K1-G5
cccacgcgtccgcggcggccaaggggagttacacgctagccggcggtcggccagccgccggcaagcgcctcagccccaacagtcgcaccgccgccgccgaggcaaactcgaagccacccccgccgccgcagccacagccgcgccgagcttgagccgtcgttgctccgctgaatcgcccccatcgtctctcctgaagagagaggacatttattgagacagcatgcctaagataaagacaagtcgtgtcaagtatcctgaaggatgggagcttattgaaccaaccatccgtgagttggatgccaaaatgagagaagctgaaaatgatccacatgatggaaagagaaagtgtgaagctctctggcctatttttcgtatttctcatcaaaggagccgctacatatatgatctttact

SEQ ID NO: 79935 - DNA, 263 bp, Zea mays
  Clone ID: LIB3088-010-Q1-K1-G6
aaaaaataaaaaaactattaaaaaacaaattatcctttcaaactttaaaaaaaaaaaaacgggagcggttttaaaataaataccccacctactacataaaagcacacaacctctataatcaaaatttttctaactataaaaatcaagctcatacccactcacttatagcctacataaaatgctaactaaccagctcttctcactccttttactcttgatcacactattttatcaatgaacaattactttataccccatcctta

SEQ ID NO: 79936 - DNA, 301 bp, Zea mays
  Clone ID: LIB3088-010-Q1-K1-G7
cccacgcgtccgcccacgcgtccgctcaccgtcacccgcctcgccgccgccgtcgccgggagtgcgtctggcagagccgccgccccgacagcgccaccaactccctgccgggactcctgctcgccctctgatcactctgagggataaattaaataccatctctatctatatactacgtatcatccttgtcgtcgtcagtcagtcagtgcaaccgtgtgtatgtatgtatctacgtacgtattgtatttgtatcccatccatggccgtatgtcactattatatatatacagtatatctcatc

SEQ ID NO: 79937 - DNA, 265 bp, Zea mays
  Clone ID: LIB3088-010-Q1-K1-G8
ctcacacattctcccacacttgctttagattaactacatggagacctccaaccgggagaggatgacttttgctattggggcgctcctaaaggttcttaaaaatctctggcatgaacatcaagtgctgctaagataacatatgaaggatggaactgcggacactcgatgaggctatgattcatgaatatcttgctgaaattcaggcacaccttgatgcccttgagtctttatataaatgtaactctagggacacctattcattgta

SEQ ID NO: 79938 - DNA, 325 bp, Zea mays
  unsure at all n locations
  Clone ID: LIB3088-010-Q1-K1-G9
cccacgcgtccgcccacgcgtccgggagagctttgaggggaggggaggggagctggctagctactagaggagggcttcctccggcncacaacatgggggaggtgaagcacctgtgcctggccaagttcaaggagggcgtcgtggtggacgacgtgctcaagggcatgaccgacctcgccgccgggatggacacggtcaagtctttcgagtggggccaggacgtgctgaaccaggagatgctgacgcaaggcttcacgcacgtcttctcgctcaccttcgcctacgccgccgacctcgccgcctacatggcccacgacagccacac

SEQ ID NO: 79939 - DNA, 444 bp, Zea mays
  Clone ID: LIB3088-010-Q1-K1-F10
ggttgttgtggagttggcaaaagctcatgagatccaggctgctgtgctgttgcacgctggttttgttaccgttgacgatatcaaagaggtcaagtgcgcaatttctatcctcggagctgagattgacaaaatgtccccaccggagctaatcaagcagttcgagcaggtcctttctttgaactcaggggttggccacttcgtcaagatcttccctggtgtggcgcatggatggagcgtgagatacaaccacgacgacgcagctgccgtgaagagtgctgaggaagcctttgcggacatgctcgactggttcaacaagaatctgaaataaactctgcaattgcatcctgccttgtaataatgcgtgttccagtgccctgggatcgaatctgctgtgtttgggcttttgcatggtcaggctattcagagttgtcatggacttaaggt

SEQ ID NO: 79940 - DNA, 397 bp, Zea mays
  Clone ID: LIB3088-010-Q1-K1-C9
gcagactgttcttgaattaggcccaaccatcccaatttttggagtttgcatgggtgtgcgatgcattggagaggcatttggaggtaacatttatattcataccaggtcgctagttttttaatggcctctgcttttgtccctcaaacatttatgacatgaatatgcaggaaagattatccgtgctccttctggagtgatgcatgggaaaagctctccagtttattacgatgaggaattaggaaaggcattgttcaatggcttgccaaagtatggtttaattccttttgctctgctttcaagaaagcaaatattcagtatggtttaatttctcaaccgttgaatcatctgaatgttatttggtttggtaacctcttatttcttttttttttagtatgag

SEQ ID NO: 79941 - DNA, 378 bp, Zea mays
  Clone ID: LIB3088-010-Q1-K1-D10
cccacgcgtccgaacaataccactatatttgttggtgggcttgaccccaatgtcggtggggataccctaaaacaagttttttctccttacggtgaagtcgtccatgttaagatccctgttgggaagagatgtggttttgttcagttcgttaccagaccttctgctgaacaagcgctgctaatgctgcaaggggccttgattggtgcacagaatgttcgactttcatggggtagaagcctgtcgaacaagcaggctcagcctcagcaggaatccaatcaatggggtgcggctgctggtgctggtggctactatgggggctatggacaaggttatgaggcttatggcagtgggtatgcacaaccccaggatcctaacatg

SEQ ID NO: 79942 - DNA, 384 bp, Zea mays
  unsure at all n locations
  Clone ID: LIB3088-010-Q1-K1-D11
tccaaacgcagcaaagcccctagcgccgccggtctcttcagcctcgcagcacacggggcggcagcccgagtgaccgctgcagcctanggtttccggcggcgatggcgggtaagggagggaagggtctgctggcggccaagacgacggcggccaagagcaccgacaaggacaaggacaggaagaaggcccccgtgtcgcgctcctcccgcgccggcctccagttcccggtgggtcgcatccaccgccagctcaagtcgcgtgcctccgcgcacggccgcgtcggcgccaccgccgccgtctattccgccgccatcctcgagtacctcaccgccgaggtcctcgagctggccggcaacgccagcaaggacctcaaggtcaagcgca

SEQ ID NO: 79943 - DNA, 420 bp, Zea mays
  unsure at all n locations
  Clone ID: LIB3088-010-Q1-K1-D3
accggaaanncccggncggaccgacgcgtccggcactacaacaccattatgttcaccatcttcaatggaagtactcgcttggctcattcaagctcgtaggccatactgctccagcgcaggcagcatcattgttaatagtggggccttttgtggacttctggctgactaacaaaagagttgatgcttttaactacacatcaatagttacgttctttatcgtgttgtcgtgcataattgccgttgggacgaatctaagccaattcatatgcatcggaagattcacagccgtctcgttccaagtcctaggccacatgaagacagttctggtgttgaccttggggttccttttctttgggaaagaggggctcaacttccatgtcgcccttggcatgcttctggctgtgatcggcatgatctggt

SEQ ID NO: 79944 - DNA, 329 bp, Zea mays
  Clone ID: LIB3088-010-Q1-K1-D4
gccggatccggtcgccgacgcgtcgccacgcgtcgccacgcgtcgtgactttcactctatatacttacagctacggcgtaacaagtcgcaatccctctcagagagtcagaaatggcatacctcatagctgtttcgcggctggcagacacgagccagtcgcagtgcgctgggtccggctgatcctgagctcggcacgtcttcccggcggaggagcctgctggactgacaagccgcggcaggcgctctgcgtaccaaacggcccgtctgcaggcgatccgggtccatattggacggccgttcacccgcgcaaaggcgggtaccgacttctc

SEQ ID NO: 79945 - DNA, 411 bp, Zea mays
  Clone ID: LIB3088-010-Q1-K1-D5
ccagacatcgacttcgcttccatccacctttaccctgacacctggctgctgcagcagcgggccgcggtggacgagaagctcaagttcgtgaagcggtgggtggcgtcccacatcgaggacggggacaaggagctgggcaagccggtcctcgccaccgagttcgggctgtcgcaccgcgccaagggcttccaccactcccaccgcgacgtcttctacaaggccgtctacgacaccgtctaccggtcggccgcccgcggcggcgccggcgccggcgccttcgtgtggcagctcgccgtggaggacatggaggagttccacgacgacttctccgtcgtgcccagcgagcacccctcgctgcacaggctcatcaagtcgcaatcgtgcaggctggccaagcttaggcacggggtc

SEQ ID NO: 79946 - DNA, 203 bp, Zea mays
  unsure at all n locations
  Clone ID: LIB3088-010-Q1-K1-D6
cccacgcgtccgcccacgcgtccgctgtagctgctctccccgctcttgaaatcaacaaggaatagaaatccatggaggctgggcggcatcanatagtggntgacggatatctaggatggatggatggatggatggaacacagcattgcacatgcagctaaagcttctgctagatcgatcagagcacggccaccttttccacag

SEQ ID NO: 79947 - DNA, 382 bp, Zea mays
  Clone ID: LIB3088-010-Q1-K1-D7
cggacgcgtgggagagaagttgccaaattacgaggctaagataaagaatttctttgaagagcacttgcatactgatgaagagatacgctattgccttgagggcagcggctactttgatgtgagggaccaagatgatcagtggatccgtgtagcggtaaagaaagggggcatgatcgttttgcctgcaggaatgtatcatcgctttacgttggatagtgacaactacatcaaggcaatgcgtctatttgtgggtgagcctgtctggacaccatacaatcgttcgcatgaccatctcccggctaggaaggagtacgtcgagaaaatcatcaaccgaagtggaaaccaagccgtcgaagctcgttgagcgtgtccactctacatg

SEQ ID NO: 79948 - DNA, 414 bp, Zea mays
  Clone ID: LIB3088-010-Q1-K1-D8
catctctcgctgcacgactcaggtcttccccgggggctggacggcggtcctaggcgcgcgcgacaacgttggtgtctggaatctgcgcgccgaaaggctggatgactggtacagagggcaggaggtctatgtgaaggttgccgatccactgggctacaacatcaccgagatggtcgtcccggacaatgccctctactgtggtctactgaaggagaggcaaaagccacaggttcatgagtcgaacagcaagtcgtcggcgcaaggcgatgctggatggagcaaccgactcctcgcaaccatgatcctggtcgtcgcagctgtgatcttcagttgatcctctctctttttttttctccaaagttttttggtagaattttgcctagaggaaatagaacattgaaacgtctagcctac

SEQ ID NO: 79949 - DNA, 411 bp, Zea mays
  unsure at all n locations
  Clone ID: LIB3088-010-Q1-K1-E10
cgcagaactgggccaagatccgcagctgcctccaggacggcaaggtctgccagaagcttgcgtccagaaaggagacggccgcccagttcgtcaacagcaacctctccccgatccagtctggatgctgcaagccaccaacgggttgcaacttcacctaccagagcgaaactgtctgggccaagcccgctggtttcaacaccacaactgacgaccctgactgcaccacatggtcgaacgaccagaccgtgctctgctacgactgcatggcctgcaaggcaggcgtgctggccaacctgaagaacgactggaagaagatcgccaccgtcaacatcgtcttcctgatcttcctcgtcgtcgtctactccgtcgggtgctgcgcgttcaggaacaanccgcaggacaactcgtacc

SEQ ID NO: 79950 - DNA, 293 bp, Zea mays
  Clone ID: LIB3088-010-Q1-K1-E11
cggacgcgtgggcgcgagcgggcgccctttttttttttttttcttgcaaggtttgaggcggctttctttagaacacatgctaattattttttttgtttcattggtgtatgaaactaaatcttgatattcatgggaagcttcgagttctttttccttttggcttactgcgcaagaagggtaacgagaggacggcggcgatggcgaagaggctgctcccgtctctgaaccgggtgctggtcgagaagctggtgcagcccaagaagaccgccggcggcatcctcctcccggaaaca

SEQ ID NO: 79951 - DNA, 214 bp, Zea mays
  Clone ID: LIB3088-010-Q1-K1-E12
gcggacctgggaaaaaaaaaaaattaaattaaaaaaaaaaaaaaaaaaaaaaaggggggtactgctattcggaacagtataactcaagcatcatgatgattgttgatggcttcaagtgtgaccaatgtttgcttcgactctcacttgaagccatcaacaacaacatggatgcactaaaataatcttcttgtataactcaagttctagatcgcga

SEQ ID NO: 79952 - DNA, 97 bp, Zea mays
  Clone ID: LIB3088-010-Q1-K1-E3
aaaaaaaaaaaaaaaaggaagttttaataaaatattagaaaaaaaaaaaaaaaaaaaaaaaaaaaaaaatatcaaaactttttaaaaaattaatact

SEQ ID NO: 79953 - DNA, 367 bp, Zea mays
  Clone ID: LIB3088-010-Q1-K1-E4
cccacgcgttcggttggcttctcctccctttccggttcgggttcgggttcgtgaggttcgccggggttcggtttcgtgggtgagcggatcgagatggcggcgtccgatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggag

SEQ ID NO: 79954 - DNA, 240 bp, Zea mays
  Clone ID: LIB3088-010-Q1-K1-E5
ttccgcaagaggatggggaatggcctaagttaacatttcctagttctagcttaaatccttgtagggggctgttaaaaggagactggtggtctctgccatcaaaaccctgtgcagaatagtggtacgtgcttctttacttccctattagattcagtttatttctatgtaatgcttgtttttcatgtaacatcctttagattttgttgttcagtgatatctgtctcgcataatttgtcttac

SEQ ID NO: 79955 - DNA, 195 bp, Zea mays
  unsure at all n locations
  Clone ID: LIB3088-010-Q1-K1-E6
aaagttcaagtaggggtataccccctggtgggttttcttcaagaaaagaagagagaaaagaaaaaacacnaaaaaaaacaaaaataaataaaaaaaaaaataaataaaataaataaaaataaacaaaaataaaaataaaataaataaaaaacaaataaaataaaaaataataaaaataataaaaaacaaaataaa

SEQ ID NO: 79956 - DNA, 371 bp, Zea mays
  Clone ID: LIB3088-010-Q1-K1-E9
cattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctacctcgcggccgtcctggagtacctcgccgctgaggtcctggagctcgccggcaacgctgccaaggacaacaagaagacgcgcatcgtcccgcgccacgtgctgctggcgatccgcaacgacgaggag

SEQ ID NO: 79957 - DNA, 379 bp, Zea mays
  Clone ID: LIB3088-010-Q1-K1-C8
cggacgcgtggggtttttctcaacgtctttcatactaatgatattagcaaattatgtaagataataaccatgatatacaacttatataaattattatgttatatttgtacattttagctaaactatttgacatctaatataattgtaagttcataagcgtagatatattttctagatatgagcttagcggtaggtaattttgcttatctattaccgtaataagcttgatgactgaggtagacatctgatttatatttaatctaactgtttctctatgtgaatggatacatatattaactcaggtagcactacaactagcaatgtatggatgaattgaaggaagtaaaagaaggcagacaatcttataaaaactctgcat

SEQ ID NO: 79958 - DNA, 181 bp, Zea mays
  Clone ID: LIB3088-032-Q1-K1-G4
cccacgcgtccgcagagaatcactgcacaaaaacctcggcaaactcttatctatgatctgcagactgcagtgcaaaatattgttttgcattgtagacaacactattatagagtggattttgaaattagatacagagataaataagctgctggagtaagttagcctcaaactgattcgctac

SEQ ID NO: 79959 - DNA, 313 bp, Zea mays
  Clone ID: LIB3088-032-Q1-K1-G5
cttcgcaaagcgccgacgtcttcccatccttcatggctccgaagaaggatggggtcccggccccgtcgtcgaagcccgtcaagtctctgctgtggcaagcagaagaagaagaagtggatcaagggaaagctaatggagaaggtgaacaactcggtgcttttcgaccaggcttcctactacaagctgctctttgaggtgcccaagtacaagcagatcacccttctccattctattctagcgtcctatgatcaatggctctctggctcgtagggctatcaaggaccttatggctcgtgttcttatcctgttggtc

SEQ ID NO: 79960 - DNA, 282 bp, Zea mays
  Clone ID: LIB3088-032-Q1-K1-G6
gctggattgcttattggatggactcttgtgtggctactgccctatctggaggttccatcgacttccatgaccgtaaaggtgacaggataaatgccttctgtgcacactagattgaatggcaatacattgcatggcaataggtaagttccaagtgtgtgcttcatggatagtgagatggggcatcctttttggtattcttccatgatactctgttgatttggtgatgatagcttgatgccttatgttggttcatgcatatataggaaggatctggtgtactta

SEQ ID NO: 79961 - DNA, 369 bp, Zea mays
  Clone ID: LIB3088-032-Q1-K1-H1
cccacgcgttcgaaacactttgccccctacctgcagttagatccagccgcttcatcatagaagattgggccaatttgcttgcatccctgctgtatctggacccccaataatttgacacgacgcaatgtagccatgatgtgtgctatacaatttgatagtgtgtggcctgtttgagtcaattatatatgccagcattggatcctcgccctctacttagtcacattagtatacaataagtggtggaaacagtttactgtaatgaccgctacagatgcaccgtctcatgattggtcctgtggctctagtttcagccaatctggaacatggtggccagtgtatcttgtctgccaatgactgaatgctttatgt

SEQ ID NO: 79962 - DNA, 343 bp, Zea mays
  Clone ID: LIB3088-032-Q1-K1-H11
gtgcgtgaggagtctggagtcggacggaatcgaaaaggcgaaaactcagtgtctcgaggttcctcggagcggaggcgatggctgggaagggagggaaaggcttgctcgccgcgaagactacggcggccaagtccgccgagaaggacaaggggaagaaggccccaatctcacgctcctcccgcgccggcctccagttccctgttgggcgtatccaccgtcagctgaagcaaaggactcaggcaaatggtcgcgttggtgccaccgcagccgtctactccgctgccatcctggagtacttgactgccgaggttctggagctggctgggaatgctagcaaggatct

SEQ ID NO: 79963 - DNA, 280 bp, Zea mays
  Clone ID: LIB3088-032-Q1-K1-H12
gtaaggatgttccctgtctgggcaacaacaattgtgttttctgctgtatatgctcagatgtcaacaatgtttgtggaacaagggatggtgcttgacccatccttgggctctttcaagatccctccagcttcactatctactttcgacaccctaagtgtcatcatatgtgtcccgatgtatgattacatcgtggttccaatagccaggagattcactggcaacgagaggggctctacagagttgcagaagatgggtattggccttgtaatttccatcataa

SEQ ID NO: 79964 - DNA, 315 bp, Zea mays
  Clone ID: LIB3088-032-Q1-K1-H2
caaacatacatcaaatataaatatacgctctcaaatatctagtacttataatgtgataggatcacatgtattgttgatatgccagatggtaggcttcattgatgtctttaccttatcttttacaggttaaattttggaatcgcaggaggttgaactcatgacctttggacagcctcagataggcaatcctgcatttgctggttactttggttaaccaagtcccaaaaacaattccgtgtgacccattaaaaatgatattgtgcccgaattaccaccgtattattattacctaagtgaatggacaatccaccactt

SEQ ID NO: 79965 - DNA, 446 bp, Zea mays
  Clone ID: LIB3088-032-Q1-K1-H4
ccacgcgtccgcggacgcgtgggttccagcagatccttaagaaggaaggccccaagtccctgttcaagggtgctggtgctaacattcttcgtgccattgctggcgctggtgtgctttctggctacgaccagctccagatcctcttcttcggaaagaagtacggctccggcggtgcttaaatggagaaaaatgatgacgaacaagagcagttcgctcccggtccagcccagtcaggatctggtcaagtttttgcctttcatatcgaagaaattaataatttatgtaggagaatttttccaacattcgttttgggcggagacattgatctcaaaacactcgtaactgtcctactaggtggtggcatgggtccccaaaacatggtcatagggtgtgtctagtcttgccttcgttgcagccgggcaattttccttacatatatgctttgc

SEQ ID NO: 79966 - DNA, 278 bp, Zea mays
  Clone ID: LIB3088-032-Q1-K1-H6
atcaaatttcaatatacgctctacaaataacttgtacttattttgtgataccatcgcatgtattgttgatatgccagatggttggcttcattgatgtctttaccttttcttttacaggttaaatttggatcgcaggaggttgaactcatgacctttggacagcctcggataggcaatcctgcatttgctgtatactttggtgaacaagtcccaagaacaatccgtgtgacccatcagaatgatattgtgccgcatttaccaccgtattattattacct

SEQ ID NO: 79967 - DNA, 270 bp, Zea mays
  Clone ID: LIB3088-032-Q1-K1-H7
cccacgcgtccggaggacaccaacctctgcgccatccacgccaagcgcgtcaccatcatgcccaaggacatccagcttgcccgccgcatccgtggggagagggcctaagcatcgtatattctgtcatcagtgcccgatcagaagatgtagagatgtgctgggttctgtagtttgggttactgtcgaatcatcgagtagttggttgttcactgctgtaacttattatcatgatgcatatgaaatggcaatgaactatgttatcagttctcg

SEQ ID NO: 79968 - DNA, 450 bp, Zea mays
  Clone ID: LIB3088-032-Q1-K1-H8
gccagtacgatttcgctgcagcaggaggcgtcgagtgtcttcaaaggtcctacagcaatgcacaacggcatgcagctggaagcggccaggtccttcctgggacctaaccaagttcaattccagcaccacccaccgtcgtcgtcgtttcaacagcagcagcaaaacagtttccatggctttggtgtcaacccgcagtaccagcagcatgtcctcaaccagcttctgcaggaagttaagaacagtaacaaccgctcgaaagcgcagcaaccgtctctggatgcaccaccgtcgaatgcgaactgcgggggtctcgcgccaggagttgctacccccaacgtcattgctgctactggggagcaggggcagcatgtcaataacagtagctctaaccataacggcacggtaaagggtgctgctgggactggccctagcaatgtcatcaacaatagc

SEQ ID NO: 79969 - DNA, 334 bp, Zea mays
  Clone ID: LIB3088-032-Q1-K1-H9
cagcacgacgcggcggcgagctacacgccgcatcaggaggccggcactgacgagttcatggacgaagaggccatcttcgagatgccgcagctcctgcggaacatggcggcggggatgatgatgagcccgccgaggctcagccccgacaccttcgacgagtcgcccgacccgtccgaggccggggagagcctctggagctaccatgacccgcagattgttgcacacctagctagcttggccatggcaccagcagtgtggttatatctcataccatcatagtgtactactagttcacaccacctgctggttagcatacccagagaagttgattatt

SEQ ID NO: 79970 - DNA, 390 bp, Zea mays
  Clone ID: LIB3088-033-Q1-K1-A1
cccactcgttcgggcttctccaggtagaatgcatgcaggtccatgcgaatgagggtggcgttactcaaactcggggtggcatatattggataatcttgcccgctggatatctgggttcatctttttggggaatggtgttcatacttgcatccacaaatctcctcactacaagaattgcagcgggttgtttcatacttgcactgtttattgtcctttttgttgcagacaattggtttcttcgctggctctgccttggattcattgtattcattgctgttgtttgggtcatacaagaatttacatctttccatattctgaaatatgtgatcttattcataggtgtgatgaacagcttaattttcggtttattgatatttatgacgactttga

SEQ ID NO: 79971 - DNA, 398 bp, Zea mays
  Clone ID: LIB3088-033-Q1-K1-A10
gggcgacggcgacggccacgtcggcctgtgagtcaagtgcgccaaggaggtggcgaccggcatccgcggcgccatcatccgcgccaagctctccgttgttcccgtcaggagaggctactgggggaacaagatcgggcagccgcacaccgtgccctgcaaggtcaccggcaagtgcgggtccgtcaccgtgcgcatggtgcctgcgcccaggggttctggcatcgtcgccgcgcgcgtgcccaagaaggtgctgcagttcgctggcatcgaggatgtcttcacctcgtcccgtggctccactaagacccttggcaacttcgtcaaggcaaccttcgactgcctcatgaagacctactgctttcttacgcctgaattctggagtcagaccaagttcttca

SEQ ID NO: 79972 - DNA, 255 bp, Zea mays
  Clone ID: LIB3088-033-Q1-K1-A12
ctgactcatgtgcagacgcgtgggtttgttaaaaaaaaaaaaataataaaaaaaagaaggtttttataaaaaaaaaaaataaataaaaaaaaaaaataaaaaataaaataaaaaaataatttaataattaatcaatttttattaattcattcatataattattttactattattattatattatataaataattaattattaatctattttttttatttatataattatttttatttatcttatttatttttttt

SEQ ID NO: 79973 - DNA, 240 bp, Zea mays
  Clone ID: LIB3088-032-Q1-K1-G3
cggacgcgtgggaaaaaaaaaaaaaaaaataaaaaaattaaaaaaaaaaaaaaaaaaataggacaaacgtaataaaaaaaaaaaaacttacgtactcctacatgcaccaagtcttactatcctatacattcacctaaataaaatttcattagggcgtcacttttaattcaatttatattgccaaaaccttatacattacttaacttaaatatctttgaggtcatccaactttatccattt

SEQ ID NO: 79974 - DNA, 447 bp, Zea mays
  Clone ID: LIB3088-032-Q1-K1-E4
atcagcgctctttttactgtggtcaggctcagagctgctctactagttatcagatccagggctcatgtgatatcatactctcctgctacaacgcgtgggagagactactctggctctcccacgagacacgaagcctatcggtcatctcctgccaatcgactgccacaggaacatgaagagcatataaagcggaggtcctactctcctgccaggagatatgatgctgacaatggctatgagaagaggtctcccacaacagacagggaccgatctactatgcaccgcatgtaccccataagatactgacgcttacctcctggatcccgctccaggtccgccgacgattcttctgttgccagggactgatcgaccgatggatgggtacaatatgaatggtatgcgcatgaccagcatggtcatgcggtcaataggcctatgtctttgtca

SEQ ID NO: 79975 - DNA, 444 bp, Zea mays
  Clone ID: LIB3088-032-Q1-K1-E5
gcaagaaggaaattcagctgcagcttgagaagatgaagaaatatgcttctgttatccgtgtcattgctcatacccagattaggaagatgaagggtttgaaacagaagaaggctcacctgatggagattcaggtcaatggtggtaccattgctgacaaggtggactacggctacaaattttttgagaaagaggtccctgttgatgctgtcttccagaaggatgagatgattgacatcattggtgtgaccaaaggtaaaggttatgagggcgtggtcactcgttggggtgtcacccgccttccccgcaaaacccacaggggtctccgcaaggttgcttgtatcggtgcatggcatcctgctagggtctcctatacagttgcccgtgctggtcagaacgggtaccaccaccgtaccgagatgaacaagaaagtttacaagatcggca

SEQ ID NO: 79976 - DNA, 439 bp, Zea mays
  Clone ID: LIB3088-032-Q1-K1-E6
cttggtcgcctggcaaagtgcgttccatccgagcggtgatgtgagatgtgtcccccctattcttcatcggtttgcttgcaatgattgagatagatgtgctcattcgccttgcagaaaatgaaaaataaagatatctttgtgcccagattcagagatggtttgactacctaatcatatatgcatggtacaacagccataaaactgaattttatttggctagaacctgaaatggcggaaactctcaggaatcatggtgcaaccgtgcatggatcacttgtctaaactagttacatcattttgattaagaataaggattacctgatggttgtctcctattttctgttgtagtgcaaaccgtctaaagctgactgttggatggggttggcgaaggtgtgcttgaataaggatcacctgaaggcgtggagtccctggctgctgg

SEQ ID NO: 79977 - DNA, 440 bp, Zea mays
  Clone ID: LIB3088-032-Q1-K1-E7
gatgatttgcaatccttcggcgagcaactgaggaagaactatgaggagacaaaagagctactccttcaggttgctggtcacaaggacgtccttgaaggtgatccttatctgaagcagcgtctgcggctgcgtgagtcctacatcaccactctgaacgtgtgccaggcctacaccctgaagcggatacgcgacccgagcttccaggtgagcccgcagccgcccctgtccaaggagttcaccgacgagagtcagccggcggagctggtgcagctgaaccagcagagcgagtacgctccaggcctggaggacaccctcatcctgaccatgaagggcatcgccgccggcatgcagaacaccggctaggccaagatcttcggtgtgcaaataacctgtctcccatgagacggtggacgatatgtgtaggcctgtgagcagttagt

SEQ ID NO: 79978 - DNA, 333 bp, Zea mays
  Clone ID: LIB3088-032-Q1-K1-E9
gggcagacctcgctcgggatcaaagctgtcaatggtgtagtcattgccactgagaagaggctgccttctattttagtggatgaaacatctgtgcaaaagattcaggcactaacacctaatattggagttgtctatagtgggatgggtccagatttccgtgttctggtgagaaaaagtcgaaagcaggcacaacaatattatcggttgtacaaggaacatatacctgtaacacagcttgtacgagagactgctgctgtcatgcatgagttcacacagtcaggtggtgtgagaccatttggagtatcactgttgattgctgtgtattgatgacaa

SEQ ID NO: 79979 - DNA, 358 bp, Zea mays
  Clone ID: LIB3088-032-Q1-K1-F1
cacgtctctctctctatatgtgtccgtccctgatgggttatgtctcaggtttcaattagatgatggtatacggtatgataatggacgtattaccgatgactggatgactttactgaagtgtagaaaacttgttcaaacaactagttgctgaaaatgcacaaaaacatacaagaagcgctgatacctgtaaggttatgttcatagaagaaagggtttctgcaagaacatgaagtgtccctacaaaatcaatgttagatgtggacgatggggcccatttgcaagctttgaacaatttgcaaagctcatcaatgagagtgggaagatttgttagatagaatagtgtgaggcattagggaag

SEQ ID NO: 79980 - DNA, 201 bp, Zea mays
  Clone ID: LIB3088-032-Q1-K1-F10
cggacgcgtggggccgtgtggtgtcggttaaataggcaaaggcatggtgcgcctctaagtgggacatcccgtactgggagacgtctgctaaggatggaacgaacgtggaagatgccttccagtgtattgtaaagaatgctctgaagaatgaaccggatgaagaattgtatgtgccagataccgtggatgtggtaggtggca

SEQ ID NO: 79981 - DNA, 428 bp, Zea mays
  Clone ID: LIB3088-032-Q1-K1-F12
caagaagttactccaaggcctgctccgccacgattccctggtcctggtacgggggtcttccttcctccgggatcaggccaccctctgcctcatcagatgatgccggcttctcatggccatggcgaacccaactctccacaaggttcatccgcttacctgcatagtaaggtcaatggcaaggagacatctaatggcaatctttctcctaagaactcgccgagaaagacatcttgcacagccgaggagaaaccagaatgcaatgggagcttaaatggtggtggcggctctgcggatgagaagtcaactgtaggtatggagcaacagaatggtgttcagaagaatgttgggagtagcaagggccagccacatggacatgcaactgaatagagtgggacttataggacatagacaacagaaaactgaagaga

SEQ ID NO: 79982 - DNA, 402 bp, Zea mays
  unsure at all n locations
  Clone ID: LIB3088-032-Q1-K1-F3
ttgacacattgcaatataaaggactagtaaaaaaaattctagataggaagtgggtcggtctcaaaataaatgagttgttagttgtagaatattattctcgccagacttgaacttaacgaaaaaaggaaaggttcatagaatttttttccccttcccctttccccgaactaaatcgacctaaggctcttaattcgtattttcccgttcacctagcagaaatagattaaccctaggatactnttttcttttttgttatttcctcgatgtgtattttacataccacagtaatttgctatagagaatntctattaattaaaggtattattgttggaataaattgttatttaatttgatacattgtgatcgctaacattgatgaattaagagaaacggaaagagagg

SEQ ID NO: 79983 - DNA, 452 bp, Zea mays
  Clone ID: LIB3088-032-Q1-K1-F4
cccacgcgtccgttcacccgcggcaacggcaccggcggcgagtccatctacggcgagaagttccccgacgagaagttcgtgcgcaagcacaccgtccccggtgtgctctccatggccaacgccgggcccaacaccaacggctcccagttcttcatctgcaccgtcgcgaccccttggctcgacggcaagcacgtcgtcttcggccaggtcgtcgagggcatggacgtcgtcaaggccatcgagaaggtgggcacccgcaacggctccacctccaaggtggtcaaagtcgctgactgcggacagctctcctagatctctctgatctggtctgttcggcccgccttccttcgtcatcgtcgactccccctgcgttcgttcctttggatctgaataagatggtggtgatctgagtggtggtcttagtttatcatgtattgctcggaggttaattt

SEQ ID NO: 79984 - DNA, 308 bp, Zea mays
  Clone ID: LIB3088-032-Q1-K1-F5
agcagccaatgaccaagaacggtgtcacgctccattgatgcagaccgatactgatatattgtaggtcgagtgatgttagcaacatctgtgtttagaggggaggggttgttaagctccgggtgtctgatttattgacacttgcggtctgtaaggtgattaaatgtgtcttataaagttcgatttgtagggctttgcccctgtatgttcttgatatggtaacttaagttgcttcattagaaggcgcctgttcccggttgtatatgtagtagaaatatgacagtaaaacaacttgaagagtcgattaaccg

SEQ ID NO: 79985 - DNA, 424 bp, Zea mays
  Clone ID: LIB3088-032-Q1-K1-F6
cccacgcgtccgcccacgcgtccgactacttcaagtcatatttatgctgggttacagaacggcatgctattagtctttgatatccgtcaaacttctgcacctttgcattctagcatgggtctatcaacacacccagttcatacaatacactgcgctgtagatggcagtggttccaggaaggttttttctgcttcttctataggaccctgcgtttgggatgccagcgaaaacaggccgagtttggtaagtgggatggaaaaccaaggggtctgcatatctcttgcgtgcagctctccatcaagtgatgtcctggtggcttcatatcgcccgagagttgagctgccagacgctatcggcacatctcaagcgtctacaccacaatcaccggcacccaccggttcaggaaaactaggatgccacacac

SEQ ID NO: 79986 - DNA, 332 bp, Zea mays
  Clone ID: LIB3088-032-Q1-K1-F7
gtcactctggttggacagggtacacaatctacgtctcagtatttttgttctgatggtctcggtattgaatgcctaggtgagttttttttagctgtgcacaaaaaaacagttaaactcgatggtatctcaactgctggagaaatgctagtgccctatttttggctgtggaattggaaaaaaaaaaaaaaaaaaaaaaaaaaaaaaaaaaaaaaaaaaaaaaaaaaaaatataaaaaataaaaaataaaattaacataaattaaatatttatatactataatatttattttatatataaattaaaaaaaaatggggggtccttttaaaggaatc

SEQ ID NO: 79987 - DNA, 445 bp, Zea mays
  Clone ID: LIB3088-032-Q1-K1-G1
ttaacgccaccaacatggagaagaacacaccactccactgggcatgccttaatggacgtatagaggtaatcagggctttgatctcagcgggggctagcgtgagtgctctgaacagccacgagaaaacgccaatggacgaagcggtgaccacaggcaagatggacgtgatcgacgcgatcggtgcggcagtagctcaagccgagctcgacggcgttactgtctcctaaaaggacctgatgagtacctggagctttgaatgacttgcagccttgttcttatctcccagcggttctgtctgtatcactcgcgaacctgaatccccgacggcccagtatccgggcaatatctatactgacggcaatcgcctgttagtgtcattggcttgaagacatgggaggccgacccgacctgtcgttgtaaaccagatgtgcagatgtcaaagatc

SEQ ID NO: 79988 - DNA, 65 bp, Zea mays
  Clone ID: LIB3088-032-Q1-K1-G11
aaaaaaaaaaaaaaaaaaaaaaaaaaaaattaaataaaaaaaaaaagggcggccccacgcgtccg

SEQ ID NO: 79989 - DNA, 420 bp, Zea mays
  Clone ID: LIB3088-032-Q1-K1-G12
cccacgcgtccgcccacgcgtccgacgtcgtgctggagcgtgccggctaccgtgtggcgcgccgcaggaggtgcaagtcccgcgtcgggattcagcacagggtgaccaaggaggactccatgaagtggttccaggtcaagtacgaaggcgtcatcctcaacaaggctcaggccaacacgttgtaaacctcacccgtgggcaaaacagctctctggtctcgtatcctcctccgtgtcaacgcaagaccacccaccttgccagggttttttttggtttaatttgtgttctcagccctgatgtttagtctggtagcactctggtggtgcttgttgcgcaagatcaccacccatgtggattatttcccggcccttgttgcactctgtgtgctggtgcttgaaaacatgcttggttgaatctcct

SEQ ID NO: 79990 - DNA, 440 bp, Zea mays
  Clone ID: LIB3088-032-Q1-K1-E3
cccacgcgtccggaggtgttgtagctcttgtggatgggcttaagggtttcgttccattttcgcaagtgtcatcgaaaacaaccgccgaagagctgcttgagaaagaattgcctctgaagtttgtagaggtcgatgaggaacaaggcaggcttgtcctcagtaatcgcaaggcaatggcagatagtcaggcccagctaggtattggatcagttgtcttgggaactgttgagagcctaaaaccttatggtgccttcattgacatcggcggaatcaacggccttctccatgtgagccagattagtcatgaccgtgttgcagatatctcaacagttctgcaaccaggagataccctcaaggttatgatactgagccatgaccgtgaaagaggccgagtcagcctttctactaagaagcttgagccaacacctggtgacatgatc

SEQ ID NO: 79991 - DNA, 198 bp, Zea mays
  Clone ID: LIB3088-032-Q1-K1-C7
cccacgcgtccgcccacgcgtccgcccactcgtccgcccacgcgtgcgggcaggtctccatcatcctccgtgggagagaagatggtcatggagtgcgtgtgtatgtatgtgtatgcccagggcgcgcgcgcgcggctctgggcgagtcacagtagagatgcaatatcatgtatccagtatctacattacatactaagc

SEQ ID NO: 79992 - DNA, 410 bp, Zea mays
  Clone ID: LIB3088-032-Q1-K1-C8
gcctcagagagagaaaaagcggagattagcggcggcgatggcactcccggcgtcgagcgccggcctcttccgcttcgtctccccgcgcagccgcccccagtccaccgacatcgtggctgccgcctcctggggagtcttcgccggcaccgtcggcctctacctcgtccagccatttgactggattaagaaaactttcttcgagaaaccaccccaaccagaggcataaaaggcttgcaagtctgcaactttggtacttcacttttatccggaatggttcctgactgaagagaacttggataactcagcaaataatacgagaccccctcgtgtttccttgtttgcttttattattcagatgtatgcaatccccacgagggagacagggaacagtgaaactgcttggttcacct

SEQ ID NO: 79993 - DNA, 387 bp, Zea mays
  unsure at all n locations
  Clone ID: LIB3088-032-Q1-K1-C9
agggcggccagacagggctcccacaggccatcaccacaacacacaaagacagctcagagcgggtcacacacaggctcctctcccccgttgcgcaacgcgctttcccccacttcacccgcctcggcgccatggctaagctcgcgctggcgctcctcctcctgctggccgtggcggcgtccgcgtcggccagcagcgggagccacctggatctcgacctgggcttcctctcctctggggaccgccggagggagtgccgcgggacggtggccgagtgcctcgccgaggagtcggatgaggagggccttgacctggccggatcccaccgncgcgcgctctacggcggcgggtacatcagctacggcgcgctgcggcgggacaacgtgccct

SEQ ID NO: 79994 - DNA, 417 bp, Zea mays
  Clone ID: LIB3088-032-Q1-K1-D1
gtgcattggcgcgctaactgtcctagctgatttcatgggcgcaattggctcaggaactggcattctgctcgctgtcactatcatataccagtactttgagacattcgagaaggaaagggcaaccgagcttggtttctttggtttctaatcttcgtcgctggggtatagactgaatcttcctgcaagtgacagtaaatgcttggccggctgtttatgtttgtaattggagagcttatagtcagtttaggttgcgggctaatttacactgggaaatttgtagcaggttctgcatgcgtttttggggccagtatgggcattaagttgtgctcaattataaccactgtcatcatctcttgggattttccgttctcctgtattgactatagaattttggatcaattttgccgtcctgaactg

SEQ ID NO: 79995 - DNA, 313 bp, Zea mays
  unsure at all n locations
  Clone ID: LIB3088-032-Q1-K1-D10
cccacgcgtccgcccacgcgtccggcatgtgatgagcaaattgtcataccgggttacagaggaagatgttatccgtgcacgtaatcagctgaagtcctcaatccaactccaccttgatggttcaactgctgttgtcgaggacattggccgccagctgctgacctatggacgaagaattcctaccccagagcttnttgcaagaatagatgctgttgatgcaagcactgtgaagcgtgttgcaaaccgcttcatctttgatcaggatgttgctattgctgcgatgggaccgatccaaggactttcagactacaac

SEQ ID NO: 79996 - DNA, 107 bp, Zea mays
  Clone ID: LIB3088-032-Q1-K1-D11
cccacgcgtccgcggacgcgtgggaaaattaaaaaaaaaaaaaaaaaaaaaaaaaaaaagagaaaattaaaattgatctatgtccatattccaaatattacttactc

SEQ ID NO: 79997 - DNA, 451 bp, Zea mays
  Clone ID: LIB3088-032-Q1-K1-D2
tcgcccacgcgtccgcccacgcgtccgcggacgcgtggggtttcgcacaagcggcagcggcagcacaagctggtgcatctgtagtacaaatgtttgtgggccgattgcgggactgggcaaggcatcactctggtgacccagagatagatgaagctttgaagaatggagaagatgctgggctttctttggcgaagaaagtatatgcctatattcacaggaatgggtacaaaacaaagctgatggccgctgccatacggaacaagcaggacgtatttagccttctggggattgattacattattgcaccactgaagatattgcagtctctggaagaatctgtcaccgatcccgatgtgaagtacggctatgtcccgaagttgactcctgctattggcaagacgtacaacttcactgaagaggagcttgtgaagtgggaccagctgagcctgtc

SEQ ID NO: 79998 - DNA, 377 bp, Zea mays
  Clone ID: LIB3088-032-Q1-K1-D3
cccacgcgttcgtcaactcgtctgcaaactcttactacaacgcttactctaacatgttcgttgttgatgataacaattatggaatgataacaccagattagcgagaccactacttgtaccatggcatgggtatgagattactatgatatgataccatttatcatagactatgatatcactacaacgctattgatgcttaaatggaaggtcttgatggatgctatgcatgagctcatgaaatagctttgacgctttatcgatacaaacgctagctgaacatggtattctttgaggacgatagtgcttgctacaatattcaatcgactgctgtatgctacgaactggttgagctaaacgcacatcgaagcttactctat

SEQ ID NO: 79999 - DNA, 403 bp, Zea mays
  Clone ID: LIB3088-032-Q1-K1-D4
tcagagtttagaaaaattcagcaatgatgacatgtgatgtgaaggtcacgttcttcaaattacaagggtcctcgaggattctcgtgtgaccatgaattctaaatgtacataaaagtctggcggaacttatagcatcctgtaatctctgtgagccgcggtctgtcagtattgggtgggcttgctgtggtaactggtggacatgtcgagttcatccatttgggtaggccttggtgaacacggacgccccacatcatgtctcagtttgagtagtttgtgtgaactgaagggtacgtgcttcttccatgtggttgcaacgttaacttgagtcaagtgctaacaagagttgataaaattttgccccacttcgtgtttgtgacagtcttttaaagtctcttttctgagt

SEQ ID NO: 80000 - DNA, 96 bp, Zea mays
  Clone ID: LIB3088-032-Q1-K1-D5
aaaaaaaaaaaataaaaaaataataaaatttataaaaaaaaaattaaaaaaagggaaaaaagttaaaatgaatatggataaataaacatcatgttt

SEQ ID NO: 80001 - DNA, 175 bp, Zea mays
  Clone ID: LIB3088-032-Q1-K1-D6
ggcgcgtgcctctgggtcgccaggttcatgctgagtctggacatgttttgcacttttgtgttcccttcctgctaccatctgtgacagatccgctcgctaatatgggacctgagattagcttttaaaaaaaaaaaaaaaagggcggcagctcgcgatctagaactctagatcgcga

SEQ ID NO: 80002 - DNA, 372 bp, Zea mays
  Clone ID: LIB3088-032-Q1-K1-D7
atccgcgacgccgtcacctacaccgagcacgcccgccgcaagaccgtcaccgccatggatgtcgtctacgcgctcaagcgccagggccgcacgctctacggcttcggcggctaggccgcctccccttctgatgctttgatgtgacggccgtggtcggttgtgtgtctagttggccggtctactgtagtttgttctgtatcttcgtttcgaggtgttccagtttctagcccatttggtgtaatattttcactgctattatcaatggaaagccctcggttctatccccattgttctggatcaaaaaaaaaaaaaaaaaaaaaaacaaaaaaaaaaaaaaaataaaatattaaattaaataaaataataatattt

SEQ ID NO: 80003 - DNA, 445 bp, Zea mays
  Clone ID: LIB3088-032-Q1-K1-D8
ggaggcgaagaagaagccgtcggcccctttcgccgtcggagccgcgccgccgcctccgggtaacgggtacttcagcaccgtcttctccgcgccgactgcgggaagcgcaagtgacgcaaagcatgcggacttgtacacgatgctgaacaagcagagctccagagggcagaatggcagagatggcaaatcccacagccgccctacttacaaggatggcaaacatgcccatccaaatgagccatcagaatctccttactttggctcatccgtgcattacggtggtcgggagttctacagcagcgttttacggaagcaaccagccaatgaaccccatacggattacaagggggacaacccggatggctctgctaccagaggtgattggtggcaaggttcactttattactgaataatcttgctgggacctctcccttttgtgaacaag

SEQ ID NO: 80004 - DNA, 426 bp, Zea mays
  unsure at all n locations
  Clone ID: LIB3088-032-Q1-K1-E1
cggcacgattctcctcctccgtccgcgtagctctcggtttcggcgatgtcggggcgcggcaagggcggcaaggggctgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgcccgccgcaagaccgtcaccgccatggatgtcgtctacgcgctcaagcgccagggccgcacgctctacggcttcggcggctaagccgnctncccttctgatgctttgatgtgacggccgtggtcggttgtgtgtctagttggccggtctact

SEQ ID NO: 80005 - DNA, 414 bp, Zea mays
  unsure at all n locations
  Clone ID: LIB3088-032-Q1-K1-E11
ggacgaggacccatacagctaactcataagtacaactacaggctcgccgggcaagcgctgaacctgaacctggtgggcgacccggacctggtggcgagagaccccgtggtagccttcaagacggccatctggttctggatgacgccgcagtcgcccaagccctcgtgccacgccgtgatgaccggcgactggaggcccttcgccaccgaccgcgccgcggggaggctccccggatacggcctgaccacgaacatcatcaacggtggtctagagtgcggcgaggaccgctccaccgacggcgccaaagccgccaaggaccgngtcggctactacaagaggtactgcggtatgctcggagtggggtacggggacaacatggcatgcgggagccaaaagccttaccggagatgatga

SEQ ID NO: 80006 - DNA, 250 bp, Zea mays
  Clone ID: LIB3088-032-Q1-K1-E12
gagctaccttcaccaagaaaatatcctgacttgttccatgtacccgcactgtttcggtgatactatctgacaccgaatttatgcattaagacttccagtgatctggggattttaagtaacgcctgtttttattcgtgagttgtaacgctgcggttcgaggagctttagtgctgtatgatgtgtaaactatttgttgtaagttgtaaccaattgttgtaagttgtaaccagccactagttctagatcgcga

SEQ ID NO: 80007 - DNA, 452 bp, Zea mays
  Clone ID: LIB3088-032-Q1-K1-E2
cggacgcgtgggctgcaaaacgctgcaggaccgtggaggaggtgatccagaaagcgaacaacacccggtacggcctggccgccggcatcgtgaccaagaacatcgacgtcgccaacaccgtgtcgcggtccatccgcgccggcgccatctggatcaactgctacttcgcgttcgacccggacgcgccgttcggcgggtacaagatgagcgggttcggcaaggacatgggcatggacgcgctcgacaagtacctgcagaccaagaccgtcgtcactccgctgtacaacactccatggctctgaccgaccgacctctcatcctgtccgatgaacagttcaacatcacaaacaagaagaaacatgtcttgtaagatactcctccaaaggatcgggtgcctgtagctgtactcttacacctgcatggattgatgtcttgatgatgtagtgcaatgt

SEQ ID NO: 80008 - DNA, 341 bp, Zea mays
  Clone ID: LIB3088-032-Q1-K1-C6
ggcagaactaaggttcaagattatgggaaatggtgagtcagtggcacttttttggagagcaaggtgcaagagtacaagtctgcgaggatatcaatgggcaaaggcacatttgtattttttgactccaaagcgatttcagttgtaatagaaataacttattgtgtgagatcttagaaactcatgctgatagtattcaaaattgctggtcttatattgtgacaatgagagattattagtcactaaaaaaaaaaataaacaatatattaaaataaaaattaaataataaaatttgatactatttttaaatatagtattaaaatgtgaaatattttacacttaat

SEQ ID NO: 80009 - DNA, 253 bp, Zea mays
  Clone ID: LIB3088-024-Q1-K1-B6
cgggagccactcatccgcccactcgtccgcccacgcgtccgctttttgtcacgtgcgactgtcgtacaatactatagcgcgctcagaatgctgggaggtgcaagaattcatccccagtccagtcacgaaatggtttgcgtcttgactatatcgtgtaatcttattcagttattcttggttgtttgggtcaacttcgagtcattcccctgtttatatatcttttatatcttactattcctatatattttatcct

SEQ ID NO: 80010 - DNA, 293 bp, Zea mays
  Clone ID: LIB3088-024-Q1-K1-B7
caacagcggaagtgcaggagaagtacatgaaagatggggagtttgcgcaactgacaaggaggattcaatgaggctggcggtgccgtcccgcacccccactttggtagcactacgggtgaaccacgacagtgtggcacgttgaacttcggttgccagaacgatgtgaaacctgtctaaattcatgtagctcagttgtaggtgtttactgaagctgattgctgtagttgcctgatcttctgggagtaccctttgggcagtaaaaaaatgcacttgtcaccggtgaccaaccggtc

SEQ ID NO: 80011 - DNA, 335 bp, Zea mays
  Clone ID: LIB3088-024-Q1-K1-B8
cgggagccacgcattcgcaacggcacgattctcctcctccgtcctcgtagctgggggtttcggcgatgtcggggggcggcatgggcagcaaggggcgtgggcaagggcggcgccaagcgccaccgcaaggtgctgcgcgacaacatccagggcatcacgaagccggcgatccgtaggctggccaggaggggcggcgtcaagcgcatttctgggctcatctacgaggagacccgcggcgtgctcaagatcttcctcgagaacgtcatccgcgacgccgtcacctacaccgagcacgcccgccgcaagaccgtcaccgccatggatgtcttctacgc

SEQ ID NO: 80012 - DNA, 309 bp, Zea mays
  Clone ID: LIB3088-024-Q1-K1-B9
aggcttcatatgaactgctcccttatgcgtaatgtgtagcactcgtacacatccattaccaaactggcagactgtgtgctattttcaatgagtagatccggtccccgattaacccactaacataatcatcaccatacaccataaatacttatacaccgatactaatctcaccacttaatgaattcatctacatatttctcatgctaccacttatgcactaactacacacttatttttttttccggtctcacatcaatcttctcctactccctgcatttctttattgtatctcaaagatccctaacttgc

SEQ ID NO: 80013 - DNA, 438 bp, Zea mays
  Clone ID: LIB3088-024-Q1-K1-C1
cgcacgcgtccgagcatttgcacgcttgatcatagaaaatcttacactgtttcctccaatccacgctgtatgagacctaaaaatgcttaacgacccttcaagtttgcttttcaaggaaattttaacagatattgcccgtgctgattactttgagcctattaggaccttcgatgagtcctgcatggctgactttttcaaaaaaacgacctctttatctcagcacctggtatacaatcctaaagaggtatgacggcagagagggatcatcatgctttgatctttaagaattcttttgttagctcaaagactacaaaggacccttctctatgatgtatattgtatgctctctgaaatttgaagaattctgtatgaaactttggttgccttgagcattattgtatagcgcccgatagggcgctactgtttctaggttaaatt

SEQ ID NO: 80014 - DNA, 322 bp, Zea mays
  Clone ID: LIB3088-024-Q1-K1-C2
gccatatccaaggcccacgccatacctttcctgatcgacttgctgcggtcaggccaggcccgcaacagggagaacgctggcgccatcatactcgcgctgtgcaagagagacgccgagaacctcgcctgcgtagggaggctgggcgctcagatcccgctcgccgagctggcgaagaccggcacggaccgagccaagcgcaaggcaacctcgctcctggagcacctcagcaagctgcaggtgctctagtagtcccacccaccactgtccatccacagccacaccactctgtgcgcgggggcctgcgttttcgacttttccacgc

SEQ ID NO: 80015 - DNA, 333 bp, Zea mays
  unsure at all n locations
  Clone ID: LIB3088-024-Q1-K1-C3
acgcgtccgctgcaactgggcgcaacagccgatacactagctgaccgacctgctcggacacgcacacgacgcatcaccaccgaggatggcagcttcataatcatgacgagcacgacactaccctgtaactacgactcaaggcccagcatgctcgcctcaaaacaatgggtcccactcgctaaccaggccaacctactatgccaagaaccacgactgtccctagcggagaatctnagtagaccgtagacgcactactaatgacaacaactactaccactgcacaaccacatcactatgtactcgatgccatgcgctctctacttttccacgcta

SEQ ID NO: 80016 - DNA, 389 bp, Zea mays
  unsure at all n locations
  Clone ID: LIB3088-024-Q1-K1-C4
ccacgcgttcgccgtcgccgaggccttcttcccctcgctccccagctccagcaggcagatcagatccatcgaaccacgaacaggaaggaaggtangaagcctgaggggctgggctgaagttgaaccatgagtgccgtcgcggtttcgtcgtcgctgaacccgaacgcgccgctcttcatcccggcggcgctgctgcaggtggaggacttctcgccgcagtggtgggacctcatcaccaccaccgnctggttccgcgaccactggtcccgcgagcacgcccacctggatgagatagccgagcagctcgagttggtcgcccttcttgcctacgatgaggatgaggacctcttctacggcgagcaggcccctcggcggcggcggcggcctta

SEQ ID NO: 80017 - DNA, 344 bp, Zea mays
  Clone ID: LIB3088-024-Q1-K1-C5
gtcaatttgacccagttaatggaggagaaatgctgcagctggagtgctacagttttgtgaaaccgtcagatcaaccgtagcaacacacaattatcatctatcaattgatgccctcctccccgtaccaagaactgtacagtatctttgtgcgccctcgttggccggaggtctaagctaaatatgataatattttctttgtgtatatatatatttcttgttggctctgggtgatgtgtgttctgtctgtggaagggctaaaacacccatctgcagatggacgtaatataacgtgtcgttattattctatggatggattgaataaaatagcctaacaatgcttctcc

SEQ ID NO: 80018 - DNA, 241 bp, Zea mays
  Clone ID: LIB3088-024-Q1-K1-C8
aaaaaaaaaaaaaaaaaaaaaaaaaaaaaaaaaaaaagaaaaaaaaaaaaaaaaaaaaagaaaaaaaaaaaaaaaggggcgggcacacaaaaagacccaaaccaaacaaacccaaacacacaacaacaaaacaccaaccacaaagccaccaaaaaccaaaacaccagccaacaacaaacaacaacacgcacagaaaaaccccagcccaaccccaacaaaaccacccaccaccacaaccccc

SEQ ID NO: 80019 - DNA, 305 bp, Zea mays
  Clone ID: LIB3088-024-Q1-K1-D1
gcgtccggttacgaacatgagaattaatgccgctaaactcctgcaatcactcgtaccaatcctttgtcaatctgtagtggagaagagagtgaaaccatgcgtagttgagctcagtgaggacccagatgtagatgcaagatactacccacaccaagccctacatgcatgtgaccaaatcgagatatctagtcgactagcctgtccaggaattaacaaatgagatacatattggtctattctatttgaacattttaaagagtcatgtagtcttaaaaatattgaaccaccaaaggacgtaatgcatc

SEQ ID NO: 80020 - DNA, 281 bp, Zea mays
  Clone ID: LIB3088-024-Q1-K1-D11
catccaggagatgttccggctcgtgagctagcagttcaccgccatgttcggcaggagggccttcttgcactggtacacgggggagggcatggactagatggagtttaccgaggccgaaagcaacatgaacgaccttttgtccgagtaccagcagtaccagaacgccaccgcctactagaagggctagttcaaggactaggaggagggagatctccaggactagaataggctgcttaacattcagtcaccgtctgtcatgaaaaactaatcatttgctgctt

SEQ ID NO: 80021 - DNA, 403 bp, Zea mays
  Clone ID: LIB3088-024-Q1-K1-D2
gcgtccgcggacgcgtgggccttagacagggggcatattgaccccatttgtaagagtttgcatcggagcagccacaggtatcacaggcgacaatactgtctaacgtgcgcgacaagtcaaagctggatctctctggtctatggcactttcatgctatacatacgcggtctatctctgcattaccattgcaaatctacgcttaatcaaagctctggtggttatagagcacctcaacaagctgcaagtgctctagtagtcccacccaccactgtccatccacagccacaccactctgtgcgcgggggcgtgcgttttcgacttttccacgccacggtgtatgcgtacaaatgcgagtagtgtagcatcatcatcatcttgtctcgagtgtgatttctgtggggtt

SEQ ID NO: 80022 - DNA, 143 bp, Zea mays
  Clone ID: LIB3088-024-Q1-K1-D3
ggaagcatgtagtgattttgaaactactgttcttgctcaaaaaaaaaaaatattcatcagaaaaacttcaaaaatcggaagcgacaatacaaactaaacgactcaacaagaaaaaacaaaaatcacttacaaaaatgacactt

SEQ ID NO: 80023 - DNA, 200 bp, Zea mays
  Clone ID: LIB3088-024-Q1-K1-D4
ctggatcgttttgggtccgaccaacgggagaagagcggcctgtggtcgccgtcgtgtgtgggctggatgatggcctgcgctcttgtgctcctcctatatgtcagatgtacttcctccgaggagcaaggtttcgctaccttttcgtactcgctacagctacagctagtacgtactatactaataaaagctgcagtttcttc

SEQ ID NO: 80024 - DNA, 332 bp, Zea mays
  Clone ID: LIB3088-024-Q1-K1-D5
gcgaataagagggaaaagaaagccagcgtgagagacggggaggttaagatgagccggaggctgtggatcccggtgaagttgctccatgaggcagcgggtcacgtggtgactgtggagctcaagaccggcgaagtgtaccgggggtcattggtcgagtgcgaggataactggaattgccagctcgagaacataaccttcactgccaaggatgggaaggtttcgcagctggagcacgtcttcatcagaggaagcagagtgagatttatgattatacctgatatgctcaagaacgctcccatgttcaagcgcttgtaagctaggattatgggcaa

SEQ ID NO: 80025 - DNA, 361 bp, Zea mays
  Clone ID: LIB3088-024-Q1-K1-D6
tgttggccgggtcggggttcatcctgtcacaaggtagagaaaatgctaaaagagagtggggtggcttgtaagataaactgaacaagaaaatttaaaagtaatgtgccgtatgaatcgctgcttgatgctagatccaactgttcaaggatatatatagtgatggttctctgtggattactttccccttgtaaatatcttgagctattgaaaggttattaggttacagggctggtgtgttcatgttaagtttcatgattatgatgtcttgtatgtgtgttaatgtccatttaagtgtctggaaatagtttataaaacgtgattggaaatataacacataaagaaaacattggtatgaccttct

SEQ ID NO: 80026 - DNA, 372 bp, Zea mays
  Clone ID: LIB3088-024-Q1-K1-D7
cgcatacgcaaccttatcatcatccgcccttgggtgggctatccgatagaccggggacgcacaggcctctcgccctgcgggcggctccacaggagagcaaaaatggcgaccctctccatggtctccgtccccatcgcaccctcctccttgtccctttccacccggggccgcagctcctccgcatccttccccgctaagaagggaggaatcggtcacggtggcttgcggatcgagtgcatccgtattggtggtgttgagattccaaaccacaagagggtggagtactcgctgcagtacatacatggcattggacgctcacgctcacgccagatcctactggacctcaatttcgataacatgatcaccaaggac

SEQ ID NO: 80027 - DNA, 369 bp, Zea mays
  Clone ID: LIB3088-024-Q1-K1-B5
cccacgcgtccgctggaaagaagaaatggagctgatgcattttggaaatgttaacctagccgaataagttgacaggtgaagagcaggggaattgcagtgaagtctggcggtggcggcaaggggacgagagaatgtgtcaacacgagagactcgtttgcttgcagaggaggtatcatgacaatggatgtcgccaagtcctccgtgtcgaccatatatatatgaagaataataagaaaacacaaatacccaagtatttagaagcgttgaatccagatgtggcatgaggtcggagccaacgtgtacttgcatacgttacgtttatatacatgtactgctctgctgtaaaaaaaaatatataatattataaat

SEQ ID NO: 80028 - DNA, 127 bp, Zea mays
  Clone ID: LIB3088-024-Q1-K1-D9
catgaacgtcgcgggagtagtcaaggactggctgttgattgccttctcgtggtccgtgggccgttacaccgtcacaccgatcaacctgttcgggtacgggatccgcgttttaggggtgggctactac

SEQ ID NO: 80029 - DNA, 448 bp, Zea mays
  Clone ID: LIB3088-024-Q1-K1-E1
acgcgtccggatggctacgtcctcccgaagctgtacgccaaggtgcaccactgcgtctcgtgcgcgagccacgctcacatcgtccgcgtgcgatcccgtgagaagcgcagggaccgcaagccgccggagcgcttcaggcgcagggaggataggcctgctggtggacaaggaggcccccgccctggtcctggtgctgctgctacagctccatctccagcaccggttgctgctcgcccataggctttagcttttcgaccgtgttaagtcttctgcccactcagtttcggagttgtcccctgtgcgtgtgtgaagctgctatattagagttactttttgtctaaagtctgaacattttcgaagaatttgaatatctgaacatttgaatgtttgtgctgagtttttcaaagaatttgaatatctgaacaattgaatatctcacttgaacgtt

SEQ ID NO: 80030 - DNA, 176 bp, Zea mays
  Clone ID: LIB3088-023-Q1-K1-G3
cttgggtcaaggtcattcaaacaaggtttcatctttgctggcttgaaacctggcaggagttgagtagcccagaatgtttgtgtgtggttctagtgtttcagtaatgtcacagttatcaatggctcttaagtttctgcctaataaacatcgaacaggtctataaacaagctcaagtg

SEQ ID NO: 80031 - DNA, 297 bp, Zea mays
  Clone ID: LIB3088-023-Q1-K1-G4
gcgccggcatgctcattatctcaacccaaggcgtgcctccgctccggtcacccgtggctccgctcaaccatgtcgaggaggaagaccactgagcccaaagaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaagtgaaggctgaccgtgacgagtcgtcaccttacgctgctatgcttgct

SEQ ID NO: 80032 - DNA, 183 bp, Zea mays
  unsure at all n locations
  Clone ID: LIB3088-023-Q1-K1-G5
tttttcaataactacatcccccacatgctcggtttaaaaaagaagaggggcccccccaacaaccccaancccaacatcactttcctccagacccataccttctaacaactatatctccccggagtgctttacatttattctttcttcaatgccaccaacacccataccaatttttccaccaac

SEQ ID NO: 80033 - DNA, 244 bp, Zea mays
  unsure at all n locations
  Clone ID: LIB3088-023-Q1-K1-G6
acgcccacgcgtccgtccatgtccatcatgaactccttcatcaacgacatctttgaggagctgggctncaaggccgcgaagctggcgcgctacaacaagaagcccaccatcacgttccgcgagatccagacctccgtgcgcctagtccttcccggagagctcgacaagcacgccgtcttcgagggaaccaaggtcgtcaccaagttcaccagcaactgagcgcgctgcgggatccgcggatctg

SEQ ID NO: 80034 - DNA, 310 bp, Zea mays
  Clone ID: LIB3088-023-Q1-K1-G7
atccaaagccaacattggtggattgatgagctttagtggagcgccagcctgcggcttccacaacgatgtcaaccccgatgacagcttcatgagcctgatgctgaaggcccagagaccgggcgaaaccgatggcagcggtctcctccatgatgccgtcgctcatcactccgatgagagcgcgcggttcatggcgtaccacctgacagagtttgggaggtatgggaacaacgtctcactgactctggggttgcagcacgccgagaacacccagccaggcttcccctgcgtcagagaccaagacatctacaac

SEQ ID NO: 80035 - DNA, 302 bp, Zea mays
  unsure at all n locations
  Clone ID: LIB3088-023-Q1-K1-H1
acgcccacgcgtccgcaaagtgcaagctaagttcttatgctccagactttgtacctgtggcacagcgtacaaaagatgagtctggcgctgancagagagaatccagcagcgtacttgtagacaggacatctgggatacaaaatgcggctgagaagccccacgataccaaggtgatcaagcctcaggatccgtgcgtctccgaagagcaggctagcgaggccgagaaagagaatggacctcagggatgtccttgcagcggcaatcagggccaagaggaggcagcgaaaactgcaactaaccac

SEQ ID NO: 80036 - DNA, 262 bp, Zea mays
  Clone ID: LIB3088-023-Q1-K1-H10
gcgaacccattactatttgacgaaccagaccaattagctcgttcccaaccttaagtcgggcggggtccaaggtgacgtggacgtgctcatgaatgagtttgcttcccaaccaaatgacttcttcgcagacgccacttgacagatcaatgcttatgtgcaaagtgctaaggtggatggtgtataactgattttcctgggactgctcacagatacaaactggacttctgcacgagcatgggaaagaacatgccactatttatgc

SEQ ID NO: 80037 - DNA, 249 bp, Zea mays
  unsure at all n locations
  Clone ID: LIB3088-023-Q1-K1-H11
gactgctgtgttattcttgaaggttatgattgggatgggccacaactttacatgaggcaaggcctcaaagtatcttataaatactatnaatctgcattatggaaagggaaacaagctgcaaaaactgagatataaaagatgaaactttcatagcttacgtgcccagaaggcatttggtaagactcaaaaataatttattgagtgcatgaccaaactaaagataaagcctttcagttggaattgaactgg

SEQ ID NO: 80038 - DNA, 136 bp, Zea mays
  Clone ID: LIB3088-023-Q1-K1-H4
ctgctcgcgcggcgcttggcggcgggcgcggcccgctgctgggcgggtggaacccgatccctgacgtgagcgactcgcacattcaagagctaggcgggtgggcgcttgggcaggcgaagcaccaaaagctggccgc

SEQ ID NO: 80039 - DNA, 168 bp, Zea mays
  unsure at all n locations
  Clone ID: LIB3088-023-Q1-K1-H5
accaanncggaattcgacccacgcgngcgcggacacntantcaaacacctnacccaacgtctttgttaaaaaaacaacaataactacaacggccactgttaaaattggaaagtggtaaaggccaccaaacctaaaaaaacaaaacttaacaaacacncgcgcgcccct

SEQ ID NO: 80040 - DNA, 326 bp, Zea mays
  unsure at all n locations
  Clone ID: LIB3088-023-Q1-K1-H6
ttcgacgcgacgcgcgacgcgacccgtccgggaagtgcaagctaagttcgaatgctccagactttgtacctgtctcacagcgtacagaanatnagtctggcgctgagcagagagaatccagcagcgtacttgtagacaggacatctgggatacaaaatgcggctgagaagccccacgataccaaggtgatcaagcctcaggatccgtgcgtctccgaagagcangctagcgaggccgagaaagagaatggacctcagggatgtccttgcagcggcaatcagggccaagaggaggcagcgaaaactgcaactaaccacccgccagct

SEQ ID NO: 80041 - DNA, 170 bp, Zea mays
  unsure at all n locations
  Clone ID: LIB3088-023-Q1-K1-H8
cnacgcgtccgctacgagagatgaatggatgaccacattgccacctgagaaaaaagcaagagtgccaatgcattcaagtacatcagttaatatgaatggtaaaaaaagacgtggagacacaagtgtctggactgatacccctcttggtagagcacaaaaagcacaacaaa

SEQ ID NO: 80042 - DNA, 374 bp, Zea mays
  Clone ID: LIB3088-024-Q1-K1-A2
gaaggccaaagctgatgttcgggagggagatgaagcagaaggttctaacaagtcaaagtgtgaggttgaggatgatgaggaggatggtaatgaggacgaggatgagtaaatagtacgatggggaacagcagctttgcaattgagtgtttgctgctttacttatttttctatatgctgttccttttgatgttatatgctgtaaggaaaatctgtacatgatggtaccttagggtatggcatgctggagttcccctttaacccgaagagccggatacttttgccagcctcgtcagcatgtgtaaacagttggtttcttgttttatcgactaattgggtgactacccaagagttggtttgtaatcaatgaggtatgc

SEQ ID NO: 80043 - DNA, 431 bp, Zea mays
  Clone ID: LIB3088-024-Q1-K1-A4
gaccaccaagtactactgcacggtcattgatgcccctggacaccgtgacttcatcaagagcatgatcactggtacctccgaggctgactgtgctgtccttatcattgactccaccactggtggttttgaggctggtatctccaaggatggccagacccgtgaacatgctctccttgcgttcacccttggagtgaagcagatgatttgctgctgcaacaagatggatgcaaccactcccaaatactccaaggcacgttatgaagagattgtgaaggaagtctcatcctacctcaagaaagttgggtacaaccctgataagattgcctttgttcccatttctggttttgagggcgacaacatgattgagaggtccaccaaccttgactggtacaaaggcccaaccctgcttgaggctcttgaccagatcactg

SEQ ID NO: 80044 - DNA, 382 bp, Zea mays
  Clone ID: LIB3088-024-Q1-K1-A5
ggtgaggatgacgatgatgaagacaatgatgatgaagacgaagatgacgaggatgatggggatgatgatgattacgattcaaagaagaccaagggaactgctggaggggaagggcagcagggcgaacgacctgcagagtgcaagcagcagtgaggtgctgcacaatgaatgttggcgggcattggttgtggagcaattagttaggttctgcttgatgcgcaaggtcattgagttggtttgtggaaccttatagggggcgcttgatggttttatggaattggttggagaatttttctgggacatggcgttatatcattatatgtgggtagattcttcacttactgaattgcgtttcagatattatatatgtggtcttatgctt

SEQ ID NO: 80045 - DNA, 402 bp, Zea mays
  Clone ID: LIB3088-024-Q1-K1-A7
cccacgcgtccgccgcccctccggccactcgagctcggcgaaatggtcgcccacaggggccatcagtaccaggtggtgggtcgcgcgctgccgaccccgaccgatgagcaccccaagatctaccgcatgaagctctgggccactaacgaggttcgcgccaagtcgaagttctggtacttcctgagaaagctgaagaaggtgaagaagagcaatggccagatgctcgccatcaacgagatcttcgagcgcaacccaaccaccatcaagaactacggcatctggctgcggtaccagagcaggacggggtaccacaacatgtacaaggagtaccgcgacacgaccctgaacggcgccgtggagcaaatgtacaacgagatggccttgcgccaccgcgtgaagtcc

SEQ ID NO: 80046 - DNA, 364 bp, Zea mays
  Clone ID: LIB3088-024-Q1-K1-A8
cggacgcgtggggtaccttcgcatccagttgtactaggcatgatgatactttgactggggacgcatcgtccgtggacatggccaccaaggagaacatggagtctctgatatcgatcggccaggagctgctcaagaagccagtggcgagagtgaacatcgacacatggctgtacgagtcctgctactgtgagggcacaaatgcacagtcgctagctgacttcgccaagcaactctctgacgagcgcaagctacgcaagagcaatctcaactccaactaataaatacctctctcagtcacagcatgtgctctttccgcaaattcaccggttcttatttttaatttaattttaattctttgtgtgtg

SEQ ID NO: 80047 - DNA, 221 bp, Zea mays
  Clone ID: LIB3088-024-Q1-K1-A9
atattatatagcatatttgtgtatttattatagacagttactattttacaacttgttagacaattttttagtataaagattcttctttcacataatcatttataatttttttcttaatttaattttatttcctccttttctttatttttttattcctttaattattattttattttactcatttattttataaatcttttatatttaattttttattttat

SEQ ID NO: 80048 - DNA, 342 bp, Zea mays
  Clone ID: LIB3088-023-Q1-K1-G12
cccacgcgtacgtccatgtgtatgatcaactttttgatgagagacatctttgaggagctgtgcgcttataaagaagtggggctgtaatcaaataccaaatctaatctaccctaacactggattccaatctggcgaccataagaagatactagcttacttattacagcagtacccagctaggacaccctagcagaaaaagcatacgtccacaaattgaactgttgtatggattatgtgatcttacatatggatctattgtaaaccttaaccctacactacggggtgagcctctatattaatagactgagttgtgcatgactcattacaaacaaaaaataataa

SEQ ID NO: 80049 - DNA, 334 bp, Zea mays
  Clone ID: LIB3088-024-Q1-K1-B2
cacacgcgtacgtgcactcttccgaggatatgaaacagaaagtttctaactagtcaaagggtgaagttgaagatgatgagggggattgtaatgaggacgaggatgagtaaatagtacgatggggaacagcagctatgcaattgaagtgtttgctgctttacttatttatctaatatgctgaaccttttgatgttatatgctgtaaggaaaatctgtacatgatggtaccttatggtattgcatgctggagttcccctttaacccgaagagcctgatacttttaccagcctcgtcagcatgtctaaacagttgctcacttgttttatcgactaat

SEQ ID NO: 80050 - DNA, 319 bp, Zea mays
  unsure at all n locations
  Clone ID: LIB3088-023-Q1-K1-D3
caaccggtggcgtgaagaagcctcaccgcttccggcccggcaccgtcncgctccgggagattcgcaagtaccagaagagcacggagctgctcatccgcaagctgcccttccagcgcctcgtccgtgagatcgcgcaggatttcaagaccgacctccgcttccagtcctccgctgtcgccgcgctgcaggaggccgccgaggcctacctcgtggggctcttcgaggacaccaacctctgcgccatccacgccaagcgcgtcaccatcatgcccaaggacatccagctcgcgcgccgcatcaggggcgagagggcttgatc

SEQ ID NO: 80051 - DNA, 103 bp, Zea mays
  Clone ID: LIB3088-023-Q1-K1-D4
atacaactcaaatttgacaaaaaattaaaatttaaaaaaaagaaaaaaaaaaaaaggaaaatgttaaaataaaaaaggggcgaagcaaaaaaaaagccccccc

SEQ ID NO: 80052 - DNA, 267 bp, Zea mays
  unsure at all n locations
  Clone ID: LIB3088-023-Q1-K1-D5
atacaactcaaattcnacaaaaattttttttttttaaaaaaaacaaaaaaaaaacaccgccccgtttttatttaaaaagttggccaaccccaaaaaaaanccnnnccnttttatantatccaatcttacttactctttcatccaacttcataccttttttattntatcacttttttttttttcatttcccttcatattacaactttttaacttttaaaaccctccctttacccaatttaatcccttntcaacacatccccttttctc

SEQ ID NO: 80053 - DNA, 203 bp, Zea mays
  Clone ID: LIB3088-023-Q1-K1-D6
acgcagccccttcccaaccgtcaataatgttgggagttttgacatctccgcggcgctgcgggttgtgcaaggcaagcaggcgggcagtccattcttcgcttggatgccatggcgcctggtgtaaccaactggtagcgtgtgaggaggcttcgttgtattgactagtgcatatttctgggcaaaacagatgcgtttggttgccc

SEQ ID NO: 80054 - DNA, 327 bp, Zea mays
  unsure at all n locations
  Clone ID: LIB3088-023-Q1-K1-E1
accacgcgttcgagcatatgagatcatgcagtcacttgatgtgaactatgtgcttggtgtggttggaggtgttactggatattcttcaaatgatatcaacaagttcttatggatggtacgtattggtggaggagttttttctgtaatcaaagagccagattaccttgttaatggggagtatcgtattgacaaggtggcagcacccaaaatgctgaactgcctaatgtacaagctttgttactaccgatttggagaacttaccacagaatatggaaaacctncatggtatgatcgtgtacgaggagtggagattggcaacaaagacat

SEQ ID NO: 80055 - DNA, 423 bp, Zea mays
  unsure at all n locations
  Clone ID: LIB3088-023-Q1-K1-E10
acggaagaacttggtcgtccgaccaaaacccatgccaagcttctaccaaaaggaaccccaaccaggggtggaacttaagaaggtgcctccaactcgtgccaagtcaccaaaattgacccggagaaagagctgcagtgaaacccctcatacaccagagggaggaaatggcagtgcagtatgctgccggttgcatcgccacagcattgggaacgccagagatgttagcagcaaggcacaatgttctccaaagagcgcctcaaaggctggatcagctactagatccagggtcaccaaatccagngaagacctgaaggctttcgtgaagaaagtgggactgccaagcgccgcgaacttcgctgtacaaacctaactcatcangcattcactcccatatgccatttttcattttatntatacctcaca

SEQ ID NO: 80056 - DNA, 296 bp, Zea mays
  unsure at all n locations
  Clone ID: LIB3088-023-Q1-K1-E11
agcagaatcctaaaacccgcccccgcccccaacccgttaaaggcccaaaaggtcaccgttcgttgaaccggctacggaagggatcgtgatctgtccaaaaaattttggagcaccaaggcccctgggcagcagccatttcatttcagcattggtcagggtcagtgatcaaaagatgngacgagggagttatgaccatgcaagtgggtgaagttgctcgtatccagtgcacgcctgattatgcttatggagccggcgggttcccaacctggggaattcaaccaaactcagtgcttgtg

SEQ ID NO: 80057 - DNA, 176 bp, Zea mays
  Clone ID: LIB3088-023-Q1-K1-E12
gcggactgcctctatatggactagcacactccagagaacaatattaacagcacatccgatcattggttttccaaagatacaatggcgtgctcttgatgagatcaatgctggggtctgtgatgggatgacatacgatgaaataaagaaaagtcaacctgaagaatatgaaccacagc

SEQ ID NO: 80058 - DNA, 254 bp, Zea mays
  Clone ID: LIB3088-023-Q1-K1-E2
atcacttcttctcaccctccagatcacgcactccttcgagaggctctacggtcttcgttcggttgaatgagcagatggaggatcctcacctgacatgtacattaccgatcattaatgaccctgctcagctgcgacacagactaacactcgctcaacaacaacttctccacctacggcaagatcctatagtcaaagatcatgctcgatcagtagacacatacctcccgccgcttcagctttcttacctactccac

SEQ ID NO: 80059 - DNA, 332 bp, Zea mays
  unsure at all n locations
  Clone ID: LIB3088-023-Q1-K1-E4
acgcccacgcgtccgcccacgcgtccgcccacgcgtccggaaaaaagagagaaaagaagccaacgggactcatattttttgcccatgcctgcaagcatctaggtttggtgtctgtttttttggcttcttttgttgtggatctgaatccctgtaagagctctctctctctttctctttttgcatgaaatgtgtgggttctgtctgacaaaatctgcttgtgttgtgtgaatctgaacgtgaacagatcatactggagaaaaaaaaaagcagcaaaactagaaatattatttaatttgcaagctcaatcaaataatatttctagttntgcttgc

SEQ ID NO: 80060 - DNA, 287 bp, Zea mays
  unsure at all n locations
  Clone ID: LIB3088-023-Q1-K1-E5
cccacgcgttcgtccacgcgtgcgtccacgcgtccgtccacgcgtcctaaacgcgggcggggtactcactgaccgctcgggtgtgtacgcccatgttggcgagtacattcggttcggcgccggtgtggtccggtaccacgactactaatccatccaccgcgcgttcggtgactcgcgtgtgggcctcatgcccgatgctatgcccgatcacgacgaccacaaggagtacatgaatgaagcgttcctactgttcaatgaggacggcaacngatctatatctatcgtct

SEQ ID NO: 80061 - DNA, 423 bp, Zea mays
  Clone ID: LIB3088-023-Q1-K1-E6
cggacgcgtgggtgtaccccggccgatgccttgcggtgacttctgtggcgtgagcgtcaagtggcatgtctcaacgggctacaacaagggctggagtgctcgggtgacattgttcaactgggaggatgtcgacatggccaattggtttgctgccatcgtcatggacaaggcgtatgacggctttgagaaggcgtactcgttcaacggcactgcagtgggcaagaacacgatctttatgcagggtctggaggggcttaattacctggcgaagcataccaacatgagcgggtccgactaccttgttactggcaagcaacagtcagtcctctcattcaccaacaagctgaccccggggttaaatgtcgttgctcgagcatgcttcccaacaaaggtcttcttcaatggcgacgaatgcgctatgcc

SEQ ID NO: 80062 - DNA, 384 bp, Zea mays
  Clone ID: LIB3088-023-Q1-K1-F1
acggagctgactagttcttcctaaaacctgtgcttctatcagacatgaacaagctcaggccccagatactaaaaagcagaggcaagcagaaacagcaccagccaagtgacagtcacagtggcgaacgcaagaaccccacaatcagcagcagcgatagcataaacaaccgcaagagaaacggtgcaggcacctaacaaatcttgccccagctggccaacagatcaaggcacagttaactgagaactgactactacagctaagaccttttctttttcactgtactgtggcctactgatttctcacgtaaatattagccctggatttgcaaaacgcaacgcaatctgtaaactgatactgcttgagtcgaatcgatcgaaatgattc

SEQ ID NO: 80063 - DNA, 387 bp, Zea mays
  Clone ID: LIB3088-023-Q1-K1-F11
gcggagctgacgagttcttcctaaaacctgggcgggtattaaaccttaacaaggctaaaccccagatactggaaagcagatgcaagcgggaacagcaccagcaaagtgacagtcacagtggcgaacgcaggaaccccacaatcagcagcagcgatagcataaacaaccgcaagagaaagggtgcaggcaccgaataaatctttgcccagctggcaaacagatcaaggcacagttaactgagaactgactagtacagctaaaaccttttctttttcactttactttggcctactgatttgtaacgtagatgttagccctggatttgcaaaacggaacggaaatctgtaactgatacttgttgagtcgaatcgatcgaagtgattctgc

SEQ ID NO: 80064 - DNA, 230 bp, Zea mays
  Clone ID: LIB3088-023-Q1-K1-F2
gagctcactacttactcataaaatctgagcttcattcagacatccacaaactccagcgcgagatacttaataagaggtgcatctataaaacctaccacctattcgaaacccaagctttcgaacgatagaacatgcactctcagacacagaagtccattataccaccccaatagaacagccgcacgcaccacttaaatcatatccaagacgtccaactcatcatcgccagc

SEQ ID NO: 80065 - DNA, 339 bp, Zea mays
  unsure at all n locations
  Clone ID: LIB3088-023-Q1-K1-F3
acggagctnactacttcttcctaaaacctttgcttttatcacacatcaacaaactcaaggcccagatactataaaaacaggtgcaaggagaaacaccaccanctaattnacaatcacactttctaacgcaagaaccccacaatcagacacagcaatagcatataccacctcattataaaaggttcacgcaccaaataaatcttatcccagatgtccaacatatcaacgcacagctcactgataacttactaatacatctcaaaccttttctttttcactttacttttctctactaatttatcacttagatattagccctggatttgcaaaacacaactc

SEQ ID NO: 80066 - DNA, 115 bp, Zea mays
  unsure at all n locations
  Clone ID: LIB3088-023-Q1-K1-F4
gaacgcgtacacggtgtgtgtaaagctaataaaatgtcntagtgcagtgaattgtaaggaacaaccattgaatcattgtggctgcgctggattaccatggtgagcgtaatggtgt

SEQ ID NO: 80067 - DNA, 357 bp, Zea mays
  unsure at all n locations
  Clone ID: LIB3088-023-Q1-K1-D2
acgcttccgttccccttttggcttttcaagatattgggggaaggtattttgtcttgctgagacgtgtccgtattgaatctaaggggcggcaaaagaagctntatgaggttgggactgtgacagcaatttgtgttacctgcttcctgataagatgtgttgtggttgcattatctgcgtttgatgccgatgtatctctcgaggttttggaccatccagtcctagatttcttctattatatgcttgcggagatactgccttctgcgctagatctcttcgtacttcggaagcttcctccaagcgggttttcgcacaataccacccctanaactagagagtttttttaatgatgtacatgct

SEQ ID NO: 80068 - DNA, 336 bp, Zea mays
  Clone ID: LIB3088-023-Q1-K1-F8
gcggttgtagcaacactatcttctttaccagacgaagttgttgatacaattgggacagtattgcgatctgaagattcagtttctgaaaggaggagaaaattagaattccttgagatgcaggaagaacttatcaaggaggaagagaaaaagaaagagaaagaagaaaaggcaaaacaaaagaaagaagaggcaaagatgaaggaaccagaaactgctgaagaagatttagctttgaaggaaatgactgatgctactgctagggaagaactgagaaaagcaaaagaacatgacaaagagaagctctgtaatatcagccgtgccttggctgtgctcgca

SEQ ID NO: 80069 - DNA, 349 bp, Zea mays
  unsure at all n locations
  Clone ID: LIB3088-023-Q1-K1-F9
ctgacaatgtgcagcggaacaaggacaagccgtcatcttccgaagaaaaggaggaccataagacctcaacgagccaagtttgccaaaccaggcaacttggcnaatccaaagccaacattggtggattgatgagctttagtggagcgccagcctgcggcttccacaacgatgtcaaccccgatgacagcttcatgagcctgatgctgaaggcccagagaccgggcgaaaccgatggcagcggtctcctccatgatgccgtcgctcatcactccgatgagagcgcgcggttcatggcgtaccacctgacagagtttgggaggtatgggaacaacgtctcactgactcttgg

SEQ ID NO: 80070 - DNA, 357 bp, Zea mays
  unsure at all n locations
  Clone ID: LIB3088-023-Q1-K1-G1
gccgcacaagttcctggtcaagtcgccaccgagcgcgctgggatcgaagctcangatgcacgggaaggccctgcccgcgagacccgccgccgtgtcaccgccgccgcccgtgaaggcgcaggcatcacctgcaaaaacgcggcgctgctcgttctcgccgtcgaggttggcgacaaggctcatgtcgcctatcaaagcgaggctgtcgctgggcaggagcagggacagcggcgtcggtgtcggcggtggcccgatgagcgggctgaagcaacggccaggtgttagcttgacggtgcggacggtgtcgagcaagatatcatcgaggtgatgatcttcgtttgtcttcggcgtcatgtg

SEQ ID NO: 80071 - DNA, 217 bp, Zea mays
  unsure at all n locations
  Clone ID: LIB3088-006-Q1-K1-C7
cccacgcgtncgcccacgcgtccgctttgctacagcagctgccatctggcacttctggattacaacatgcagaatgttgccgtttttctacacatggaggtccacttgttccattccattttgttatttcttgtaaatgattctaggcctgaaatgaaaaaaaagacatgcagttcattgtcagtacaattccagtggctactgtggacttagctca

SEQ ID NO: 80072 - DNA, 370 bp, Zea mays
  Clone ID: LIB3088-006-Q1-K1-C8
gctcaaatactgatctcactgatccagtatggctatggcaaaggcaggcgcgccgagggtctcggcggcccagctggtgactctcgggctatcactcctctgcgctgtcgccggcccggccgccgcgcagaactgcggctgccagccaaacgtatgctgcagcaagtttggctactgcggcacgaccgacgagtactgcggcgacgggtgccagtcgggcccgtgccgctcgggcggcggcggcagcagtggcggcggtggtgcgaacgtggctagcgtcgtcaccggctccttcttcaacggcatcaagagccaggccgggagcgggtgcgagggcaagaacttctacacccggagcgcgttcctgagc

SEQ ID NO: 80073 - DNA, 378 bp, Zea mays
  Clone ID: LIB3088-006-Q1-K1-C9
cggacgcgtgggggcagttcttgtcgaggctcaaggagacatgatcaacaacatcgagacacatgtctcgaatgccagcaaccacatacaacaaggcgtgagcgcgctccagaacgcgaagaagctgcagaagaactcgaggaagtggatgtgctacgccatcatcctgctgctggtgatagtggcggtcattgtcgtcgcggtcatccagccatggaagaagtgagcctagggtggctctaaacaggggggagggcgtgggagatacttttttttggctgtctgtgtaatatctgtgcagttgttgggggtggttctgtgatttatggttgtacttatggtcggcaccagagaagctttggtatttccattctttct

SEQ ID NO: 80074 - DNA, 393 bp, Zea mays
  Clone ID: LIB3088-006-Q1-K1-D1
cccacgcgtccgcggacgcgtgggtgggaatccaacgatctacataacggagaacggaatggaccagcctggaaacttgacccgagaccagtacctgcgcgacgccacgagggtgcggttctacaggagctacatcggccagctgaagaaggccatagaccagggagcgaacgtggctggctacttcgcctggtctctcctcgacaacttcgagtggctggcagggtactcgtccaagttcggcatcgtctacgtggacttcaacacgctcgaacgccacccgaaggcgtcggcctactggttcagggacatgcttcagaagcattgagatctccagagccgagcctgagcacggaaggtaccattttgttcagcttcgcctagtgtttggga

SEQ ID NO: 80075 - DNA, 383 bp, Zea mays
  Clone ID: LIB3088-006-Q1-K1-D10
gtggaaatttattggccaactgtaagcccgtcgtgatgcatagaacatttgtggtataagatttttctgttgatgtttgcaggttatttttccagcacttgacattcgagtgaaaaatgtcgcagggacatattctcttgaacataaaggagaaaatgatctcttcgcacatcagacaaggcttctactctttcagaagaaagtcatttttaggagaatcgtgaacaaaatgaccagatgtttaggcctggttggaaggacatttttcgaatgaatcagagtgagctcgaggctgagatttgaaaaggtctctcgagattctactcttgatccaaggaggaaggcctatctgatccaaaatctcatgaccagccgttggatag

SEQ ID NO: 80076 - DNA, 373 bp, Zea mays
  Clone ID: LIB3088-006-Q1-K1-D11
ccgtggcagaaattctgaagaacaatggatttgctgttgaaaagaaaattaggacctgtactgttgaaataaacgacgaatcaagagggcgtccattccaaaaggccaagattgagataatcttgggaaagagcgacaaatttgatgagctgatggccgctgctgcagaagagaggggcgaagtggaagatggtgaagagcaggcttgaaaacagtaccgatgacaagctgctgctgttgtgctctgttagtgttgtttaatttagtttaataccgtgtgcatgagatatggcacgcgttcatcaccatggcaatgtctgcaaatccatggattgatggatggatgttggttgtttcttaacattctggacat

SEQ ID NO: 80077 - DNA, 57 bp, Zea mays
  Clone ID: LIB3088-006-Q1-K1-D12
tatgacttctcagcaaatgctctatgcacctaattttactgtgaatgaggaactgct

SEQ ID NO: 80078 - DNA, 390 bp, Zea mays
  Clone ID: LIB3088-006-Q1-K1-D2
gcaactaatataggaggatcaccatgctctgaaggttcggtcatttctgtagagcgtgctgagagtttcaaaagtgtgagtgactatgagcctgaggattatggtactatggactgtggtgggtacaaagagggaatcagtaaagaaaattgcagccatgttgtagatgatggatcgaggttaattttccatacagatcaagatcacttctcttggagttggccaatggccagcagtgcttcgatcatctactcctgataatcaggatgtgctgaatggggagcttgtcttgattgaacctcagtttggttgagatgaattgacaagggtgcgagaagaggctatggaaggagctcgaaataagtgggttgccagataaatgatgttttt

SEQ ID NO: 80079 - DNA, 422 bp, Zea mays
  Clone ID: LIB3088-006-Q1-K1-D3
ggaattgtggcgaacgtcttcattgttgctccagaaagtttagcatccctggttgaaggaacccccagcatgcgaaaggatgccttgaggttcattcagctccgggatgattataagacagcgaaaatcgcttcgatgctcaactatatcatgtccgagtaatgagtgaagtggaaccggtagaccgttacactttgctgctctcgtggactattgatgccgcctgtataaatgaccttcgaaattatgtatatttgtggttccaatttatctgtattgctagcctgttttgattgggccttgctcagtttgagctgaacatgctggtcagcttcatgaggctttttcatgggttatttataagttattttctcatgtatattatgttttttattaaattttgtaatttaatttatatattt

SEQ ID NO: 80080 - DNA, 385 bp, Zea mays
  Clone ID: LIB3088-006-Q1-K1-D4
cggacgcgtgggcggacgcgtgggtttgaagatagcaacattaatggatctgaatggtcaagaagcattccttgtagcaacgagagaattgccttacgatccgatgcaattgaatctgtcacgcgctcattatcatgggaggaggatatgagctcaccttcgcctttacttgattcgacaaacttaacccccatctcaagcgtggatgacgatgaacttgaatgtgtttcctttgtgcaaaagattgtatcatctgcttctgggctaggcgacctgcggttggatatggtcttcacaggctggtacttgcctgactgccctatagaccctgcattgtgcgacaagctattggaccggaaggaggaggctgctaaatcgagggagc

SEQ ID NO: 80081 - DNA, 372 bp, Zea mays
  Clone ID: LIB3088-006-Q1-K1-D5
gtagaagagagcgagccgaggatggcgtcaccgaagccctcgtcggcggcgctgctgctcctggcggcggcggccgtgctggcgctggcgcgcgcggacctgacgcacgacaactgcgtgaagaacaagaaggtgacggtgcagaacctgtgcagccacgacgtgacgctgacgctggagccgctggccaacagcccgccgctgttcgcgggcacctacacgttgcacccgcgcagccacgccgagttccccgtgtgctggtggacggggcgcctgcgcgcgcccgacgccgcccaggtggagttccacgtcggcgtcgacggcggctccttctacctggcccccaacgcgcagccgggccagcgcgtcccg

SEQ ID NO: 80082 - DNA, 312 bp, Zea mays
  Clone ID: LIB3088-006-Q1-K1-D6
cccacacgtacgcggacgcatgctctaaaattggaaaaactatgcttaaggggaacggtaaaatactgtgggggctgaaataaacttaccaattataactattaatacataaaagttcaaagcactttaacattaccatgaccagatctaagttctaactctcttgtaagcaatcttattgataggactctcatacctttgttgaacttccttaaagatacttgcatctctaataccgagattgatcatgttctactggttgttggtatgactacattaccatatctccatttaagttgtttttttatatat

SEQ ID NO: 80083 - DNA, 310 bp, Zea mays
  Clone ID: LIB3088-006-Q1-K1-D7
gagaaagaaaggaaggagaaagaacgcaaagaaaaagaaagagaccaccgggaggagagagaaaaggagaaagggaaggatcgatcaaggagagatgaaatggagtttgatggtgctgatttgaacacccatggtgcaaaagataagaaaagagataaagataaagaaaagaaacataagagacgtcaccatgacacagatgatgtaagctctgagagggatgataaagacgatgctaagaagtctcggaggcatagcagtgatcgcaagaaatctaggaagcatgcacatggctcagattcagatagtg

SEQ ID NO: 80084 - DNA, 400 bp, Zea mays
  Clone ID: LIB3088-006-Q1-K1-D8
cgcacgcgtgctcatcaaccgcgcgcgggtcgagtgccagagccaccgactcaccgtggaggaccccgtcaccgtcgagtacatcacccgctacatcgctgggctgcagcagaagtatacacagagtggtggagtccgccctttcggcctctccacactcattgtcggcttcgacccctacaccgacaagccagcgctgtaccagaccgatccttctggtaccttctctgcttggaaggcgaacgccacgggaaggaactccaactctatgcgtgagtttctggagaagaactacaaggagacctccggcaaggagaccatcaagcttgctattcgtgcacttctagaggttgttgaaagtggtgggaagaacatcgaggaagcagtgatgaaattatgt

SEQ ID NO: 80085 - DNA, 364 bp, Zea mays
  Clone ID: LIB3088-006-Q1-K1-D9
gtccgaggcggaaggtgtatacagcgccttggagaagcttggcattgactggggcgaggtcggaaagcagcttgagctggaaggtgtggactccttcaagaagagctttgacagcctactcgtgagcctacaggagaagggcaacagcctcaagacggcaactgtgtaaaactgagaagattgggtaccggcgggtgaacgattttactaaataaaatgctagcttgctggctctcttagtttttacgatgtacctttgctctccattttctgaatcgggattgtattctaggcttgcctggccgtcattgtgtgaccaacgttcatggcttgtaacaagggatcggacgtaaacggttggaaa

SEQ ID NO: 80086 - DNA, 320 bp, Zea mays
  Clone ID: LIB3088-006-Q1-K1-E1
cccacgcgttcgggggagaaagactcgatccaggcggcggccatgtccatgcgcggcaagggcggcaagggtctatgcaagggttgaaccaaaccccaccgaaaggtgctccgcgacaacatccagggcatcaccaagccggcgatcctgacgctggctcgtaagggcggtgtgaagcgcatctcggagctcatctactaagagacccgcggcgtgctcaagatcttactcgagaacgtcatactctactcctacacactacacctagcacgcgcgcacagaagaccgacaccgacatgagatgatctatactcgctcaa

SEQ ID NO: 80087 - DNA, 202 bp, Zea mays
  Clone ID: LIB3088-006-Q1-K1-E10
cgagctcaaccagccagttcacgttccgcaggtctcgctctctttcttcattaggctcgaaggccggaggtgtagcgagtgcggtcaggttctgcccgagagctactagccgtccgtctactagtcctggaccaccgggatctttggatgcaccgatgacccaaaaacttgccgaactggattgttttgcccctgcgtgctg

SEQ ID NO: 80088 - DNA, 414 bp, Zea mays
  unsure at all n locations
  Clone ID: LIB3088-006-Q1-K1-C5
ggcgctctgtgctgaacacaatgttcaccttgtcactgttcctgctgctaagactcttggcgagtgggctgggctttgcaagattgactccgagggcaaggcaaggaaggttgtaggctgctcctgtgtcgttgtcaaggactacggtgaagaatctgagggccttaacatagtgcaggagtatgtcaagtcgcactagatgtaacacgtttcagtaatactctacatttggatctgggcttaatattatgcttgcgtcttgggcttgctaggagattaggacaatttactacaagagcccatgaggatatgagcaatttggaattctaaatgttttgtttatggtgttgtcatctggttttaattcaaatcgataagagatgagatttaanaaantaaaatatttatattttt

SEQ ID NO: 80089 - DNA, 293 bp, Zea mays
  Clone ID: LIB3088-006-Q1-K1-E3
cccacgcgtccgcggcaaagagtactatgcctacacaactgagaagaagcctgcagattgattccaagtctgcacttctagcaaacaatcttgcacgccatcaactcagtgaatttgaagctgatgtgcagttttatgtctgttttgctgatgcaattagttcttaagcaaatccatggcaacttgtttatcgctgatgcttgagggatggaaatgacactcagaataaatatttgatttgctttcttgtgatcgttgatcacattaaaaaaaaaaaagaaaaaaaaatatat

SEQ ID NO: 80090 - DNA, 376 bp, Zea mays
  Clone ID: LIB3088-006-Q1-K1-A9
cccacgcgtccggccgttcccgtccagccttccgccccgcacgccgcaagcggtgcggctgccttgctacccggcgcgcgcatcgccgattcaccggtgcccgtcgctcgcagacctctccctcgcccctcgcccagcttgtcggaggccgaaattgatttgctctgtccagctctgggctctgctgctttggcctccaagcgcgccatgtgtttctatcgacaataaaattcacaatgtgcttgcccctagcagcttgccggagcttgcaactgttctgctctaaaccagtgaaacgtgaagactgaacctgcttctgcttggctgcttgctccaattcaagaatcctctcttctcggcttacttcatttactct

SEQ ID NO: 80091 - DNA, 356 bp, Zea mays
  unsure at all n locations
  Clone ID: LIB3088-006-Q1-K1-B1
gcaagagaccattgggtatatcagattcctcctgggtcaaattgaggctctcagctaccccgacatgggccacggcaatttgacctccttcttcactcaaaatgggccagctggatcagaaaggaaccctgcagggctgttcccagaataccccggccagttgctaaaccataatcataacactggagcacagcagcagcagcctgcagcagtccagcagccgcctgatgagaagcanggagtccatgaccaggtgaaaagggacttgaggagccgggggctgtgcctcgtcccggtgtcctgcacgtcgcacttcggaggggacaacgccgctgactactgggccccggcggcgc

SEQ ID NO: 80092 - DNA, 383 bp, Zea mays
  Clone ID: LIB3088-006-Q1-K1-B10
gctctccatctgctccctgctgaccgaccccaacccggacgaccctcttgtcccggagattgcccacatgtacaagacggaccggccgaagtacgagtcgacggcccgcagctggacgcagaagtacgcgatgggctgacgaacgctttcctgctcgtctgggcgccattgttcccttggatttgttgttggtcgtatgtatccctgatccatctaggatcatcgtattgtattgtagtgtatgtatgtcgtcggcctaccatcgttgccatccaccatagtgaggtggttggacatgcttcgcctatatgcacctgtgcttgccttccttcgggtcggtgctgtttggttaatgttcatcgaagacgttgatttcgttgccc

SEQ ID NO: 80093 - DNA, 386 bp, Zea mays
  Clone ID: LIB3088-006-Q1-K1-B11
cccacgcgtccgggcgaggccagtgaatactgatgtggctgctggtccatccaggactccggagaagaaagagaaagccgcatcgtcttcggcgtcggtgtcagtgtctggttcggggtcaggatcggggtctgtatccaaggatgtcgctggaaggcgggcgaagagggcgcagaagcgagaagctgcagataaggcagctgcagagaagcacctgaagcacctgcagaggttggggctgaggaaatcgccagagcctgtagtgcccgcggaggttgggccacaggtgaatgagtgacttaagccgccgccgagtgctatatggtgctgctaaaaacactgcagccctttgggccacaaaataatcttccactgtgaagagcttg

SEQ ID NO: 80094 - DNA, 265 bp, Zea mays
  unsure at all n locations
  Clone ID: LIB3088-006-Q1-K1-B12
gtgccctctgtgccgcggagacgtctgctaagtcgcctcgtgaagaccttggcgctgccatcccttcctcacggcaccggcagatagcgcatccttcctgccatcaactttttaagataccgagactgtatatagctcttgtagcctctccgtgtatgacaacctgtaatatatgtaatttctagattccaatgtcccattattctgtcctacattcagatcttattctcgcagccctgatgctcaaactagctttaccagantc

SEQ ID NO: 80095 - DNA, 316 bp, Zea mays
  unsure at all n locations
  Clone ID: LIB3088-006-Q1-K1-B2
gttgactaatgttagtgtttgtggcggaccattgtcccttaatgggctacccatttgcactgggcatgcttctttttcttaaatgtggtatgtatgtgcaagtgtttgaagtttaggctgtcatgctatatgtcagctatcaaagtaccaaatgcaactactgttctgagctgtttgcttgttacgaaacagctttccaaaaaaaaaaaaaaaaaaaaaaaaaaataataaaaatnataaaaaaaaaaacaagaaaaaaaaggactttatgtagttaagaatgaacctataaacaaattgttctgaatttattact

SEQ ID NO: 80096 - DNA, 378 bp, Zea mays
  unsure at all n locations
  Clone ID: LIB3088-006-Q1-K1-B4
cccacgcgtccgcccacgcgtccggcgagacgcgagtcgtcctcctctctggcttcggtcggcgatctatcaaggagggtgagggggaaatggccganaatccgcaactgtttgggaacgggatgccggtgccgttctacggcgagatgttcgtcctcgtccgcgacggcgtcgagttccacgtcgacaagatcccgtcagctcctggaggtcatgtgaaaacaaaaggcacaatttacctgtccaatataaggatggtgtttgttgccagcaagcctgttggcaacttctttgcttttgatatgccactgttgtttgtgcatggtgagaagttcaatcagcccatatttcactgcaacaacatctctggattcgttg

SEQ ID NO: 80097 - DNA, 392 bp, Zea mays
  Clone ID: LIB3088-006-Q1-K1-B5
ggagcactgagttcagttgctgctgagacaaatccacatgatgctcctgtacctccgtgcatcacacaactggaaggtggagttgtccaagtagccattgaagtggaagaccgggcacaacgttcagcagtaacaagagtgaatgctgatgacgttcgagtaacggtagctgcccttgctgctcgaggggaagctaacagtgagttgctagaatttatgggcaaggttcttggcctaagattgactcagatgacccttcaaagaggatggaataacaaatcgaagcttctaattgttgaggatttgtctgcacggcaagtgtatgagaagctcctagaagctgtacaaccttaggcatcgaagcaatggagcaatgtggtatgcagtatgcg

SEQ ID NO: 80098 - DNA, 190 bp, Zea mays
  Clone ID: LIB3088-006-Q1-K1-B6
gggctgcctactcctccccctcttaccaaatcctcttctgattatgcttacgtacggtttttaagacgggcgggggcggcagctgatctagattacctttacttcgtctaccggctacgcctgttccaccatcaacgaatcgactgcataataccttctactaatacggccatatccttcacttcaaagt

SEQ ID NO: 80099 - DNA, 353 bp, Zea mays
  Clone ID: LIB3088-006-Q1-K1-B7
cccacgcgtccgcagtgattctgttatggctgaaggagaacctgcctcaaatgctggtgctggtgacaaagagacaaccaaaggatgatgacgatctactacagcaggcacttgcaatgtcaatggagggtggtgcttcaggatctgcagctgtgactgactctgctatggcagaagctggtgcagttgaccctgacttggcattggctcttcaaatgtctgtccaggatgcaaacatgtccagtgacactgatatgagtaaggtgtttgaagacagaacgtttgtgtcatctatccttaattcgcttcctggtgttgatcccaatgatccatctgttaaagatttgttggca

SEQ ID NO: 80100 - DNA, 409 bp, Zea mays
  Clone ID: LIB3088-006-Q1-K1-B8
accttggcggcgagagccatgttcagtggaaggatggcaaggtggtccaggacttggttctgaagctgaggaaggtcgagagtggcctgattgtggtgcagctggagtgggttcatgttcctggcgtgaagctgtgaaggccctgtctgaatgagggctgatggagctgcagttgctgtgtccctggtttgattgtttggttgtaaacgatatcctgaacgtggtgatatgcggtgtatgagtgaggtttgagtgtgatgctttgtttggggtacttcctggtgacatgatgtgggtatgactgccaaaggttgtggcgcaccaataagaaacgccctgtcagcatgacagcatgttgtgagatgtaaactaagactttagaacctaaatatacacgtgattgggcgtt

SEQ ID NO: 80101 - DNA, 357 bp, Zea mays
  Clone ID: LIB3088-006-Q1-K1-C1
cttacgcgtacggttgagtggactggggcttgcacgagtcaccaatcaccaacactgctagctctatctgaaagatgactctaccacaggctgtaccacatgttttaggtgtcggacaattgctggaatcagcactacatgtggctggcccggttgcatgagcatctgcttcaacctcacctattacatatggtacaatgactaggcaatgagaagcccttggattgggcaccacgaagaagctatcgagctggctcgtctatggacacgaatcaactatggacagtcctatgccaagccattacactgtccatcattacgtcattcccgaggtgaaccctgccacgtttcgcacat

SEQ ID NO: 80102 - DNA, 157 bp, Zea mays
  Clone ID: LIB3088-006-Q1-K1-C10
ctacaccgcggcactgtcaacctttatgtatgttgttgcatgatgctagtttgggtcatcctctgttcaagagccattttaggctatgcctttaactttcttaagtgtaccttcgtttgtggtcattaataatgatcaaggacttctagatagcccc

SEQ ID NO: 80103 - DNA, 378 bp, Zea mays
  Clone ID: LIB3088-006-Q1-K1-C11
atcgctttccgaaaggcggattgatgggtggtgggtctggtgcgcggtagttgtcggtccaccctcaccctcaccagtgggcagtgcagtggccagtcactcactcctacccacctgccgatcttggctgccatggctcgcttgctttggttctcactcaaaggaaaggaaccctctctccacggtacgaccgggaccagaagcatccgcgtctgccgggccccacctaccgtcctttggcatccggagggccgtgcacgcctcggcgtacgacaagaacctggaggaacaggtgcgcccggcgttcgtgccggacgatgtgatcggcagcgccgggagccccgacaagtactggagcccccaccccaagaccggcgt

SEQ ID NO: 80104 - DNA, 356 bp, Zea mays
  Clone ID: LIB3088-006-Q1-K1-C12
gaaaagcgcaaggttttattgcaaccgtgcagtctgtagctatattgttggcaccactatttatgagtccactgacctcttacttcatttcagaggaaacgcccttcgactgcaaaggtttcagctttattgtggcgagtttcttcttggcaatctcgttctgcctcgcttggatgcttaacccaggaatgaaggacaagggcacaaaagctgtcgtttcagacagcgctgatgaggaagcagcgcaagcaccactactggcaaaatggaccagaccatgactccagctccaggaaactgagctataaagctcagctggagtgtgcgtaaaattgtaggatatgtgaattagagtg

SEQ ID NO: 80105 - DNA, 365 bp, Zea mays
  Clone ID: LIB3088-006-Q1-K1-C2
gcttcttcttggaaccactgcacttattttggtgacaacccctctgctattgaaaatgatccctgcaatgggccacgtcggggttcttttgagatggttttctgtcgataccaatcagctgggcctgaaaaatgatgtcctccgcatcgatagcggcaagcgcataaatctgatagtccaaggctcacatgactcatgacacatttgacacactgcaagctactttttgtatggcttaagtttacaagctctgtaaagtgttttcacctgtactgaagagtttctagcagatatacgagggtggaggcaagagaactcaactcagatcttgctcctagtgcaagatcaatcctcccccgtcatga

SEQ ID NO: 80106 - DNA, 299 bp, Zea mays
  Clone ID: LIB3088-006-Q1-K1-C3
cggacgcgtgggtagcaatcgctctttcttttcgatggatcttctattgaggaagaggatcactcaagtggaccgtgggaatgttttttttggtgttgtcttgtgttcgatggcaacacccaggtcgtgaaggcaattgataacgctatctccggcggcgcgggtgcagctggagctgtagtgctgacttacttacttggtgatccagaccgccgggttcatgctgctcatcttctgggagctgacgcgtggacgtgatggagcccatctgcttgtacatgacgtacatgtacttcatg

SEQ ID NO: 80107 - DNA, 356 bp, Zea mays
  Clone ID: LIB3088-006-Q1-K1-C4
gtatgaattatgtcataaataaaagctagggaaccttgataaataacagagagtaggatgtataccacgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcgtttaaaaaaaacaaaaaaaaaatccgggggaaaccaaataaaaaattttttaaaagggccaaaaaaaaaaaaaaaaatggcccaggttaaaaaaatgtgaagagggaaaaacccaggggttaccc

SEQ ID NO: 80108 - DNA, 448 bp, Zea mays
  Clone ID: LIB3088-005-Q1-K1-H10
cccacgcgtccgcccacgcgtccgcggacgcgtgggctccaatgcttgcaaggaaagaaagaacgtgtggaagttccggaacacagtctcggaggcccttgaggacatcacggctctgtactacgacgaggatcgcgacgagatctacactggcaaccggcacgtgcttgtccatgtgtggtcgagctgaaagctgaaactgcggggcggctttcaaccgtagcacggtgatctggtcttcacctgtgcgcgtattaacagctactagtgcctcacgtggcacgggggtggggggcacgaaagagggaccccccaagccactcaagtgacagttcttatttatctcagcatgccaagagcactgtccatcattctgaaatcagaggccccccagatctgttgtaacggacgtaccttgcaagtaatgaaatccattcgttgatctgaa

SEQ ID NO: 80109 - DNA, 418 bp, Zea mays
  Clone ID: LIB3088-005-Q1-K1-H11
ggcgcccgagggcatgaagagcctcggcacgtcgtactccatgaccagcctcggcatcgggagcttcctcagcagcgcgctgctctcggctgtgtcgcacatcacggagcgccacggccggaccggctggatcctcaataacctcaacgcctcgcggctggacaagtactacgccttcttcgccattctcaactgcgccaacctcatcgccttcttcttcgtgtgccggttctacgtgtacaacgccgaggtatcccgcgtcgtcgacaccgggagcagcaagcagaagcgggaagtggcgatgcagccggcggccgtgggcgcagtggaggccaccctatagtagctactagtgttccattacaaatgtagctgtcatactcatacgtacgtgaaaagctctgcgtgtacattgcgt

SEQ ID NO: 80110 - DNA, 327 bp, Zea mays
  Clone ID: LIB3088-005-Q1-K1-H12
ggaacgagcccggcgggcggaagggagagagcgcgccagagcggcgccgaacaaccctggtccaccgcactctcctggaccgtggccatggccatggccgacgcgtcccgatcccgggcgctgtgggcgtaccgcgccgacgcctacctcaggatctccaccttccccagggccttcttcaccgtgctgaaggatctgaaatatgctgacactcatgaatgggtgaaggttgagggcgattcagcaaccgtggggattactgaccatgcccaggatcatctgggtgatgttgtctacgtggagctgccagaagttggcgtcagtgta

SEQ ID NO: 80111 - DNA, 397 bp, Zea mays
  unsure at all n locations
  Clone ID: LIB3088-005-Q1-K1-H2
ctggaaacctttaccaaagtggataccagctcaatggaagcgcctatgtcatctcaaagcacataagcaatacatggttatgggatcgtgttcgagttagcggtggtgcatatggaggattttgtgattttgacacccattcaggagtgttctcatatttatcatatcgtgatccaaacttgctgaaaacactagaggtctatgatgagacagcaagattcctcagagagctagaattggatgatgatgcactcacaaaagctattattggaaccataggcgatgttgacgcctaccagctaccagatgctaaaggttacagcagcctaatgagatatttgctgggcatcacggatgangaacgccagcaaagacgtgaagagatactagcaacaag

SEQ ID NO: 80112 - DNA, 450 bp, Zea mays
  Clone ID: LIB3088-005-Q1-K1-H3
gatgacaagaggatccaagaggttccagcattgaaggttactgccctgacgttcaccgaggcggcaagggccaggattgtcaatgctggtggggagtgcctcacatttgaccagcttgctctccgtgctccacttggcgagaacacagtcctctagaggggccccaagaatgcccgtcaggccgcgatgcacttcggcaaggctactggagtgccgcacagccacaccaagccatatgtgcgctacaagggaaggaagttcgagaaggctcgtggcaagaggaacagccgaaggttcaaggtttaagaaagttgcgggccatcagcatactaatcacttactaccgagtagtagcacatcttgctgcctaggatcggattctgaatgatatctaaagattttcgtgccttgactactggttactggatgagcaagaagacaatgttcttt

SEQ ID NO: 80113 - DNA, 344 bp, Zea mays
  unsure at all n locations
  Clone ID: LIB3088-005-Q1-K1-H4
gaaagagtttaaagttcaaggcaacaccaatgcccagcttttataaggaaccacctnctcccaaggttgagttgaagaagatcccaacaacaagagctcgatcaccaaagcttggtcgctccaagaacacaccctcaggagggacagaaggaaattcaaaccccccagctcgttcagctcgactgagtctcgatcaaagggtcccccaaaatggtgccaagaaagcacctgctgcaaatgcggcgaagaagccccaacggaaatctctccctaaattgccttcggagcaaacagccaaagttgttgacattgcaacgtctgttccatctggagaaaagctgggg

SEQ ID NO: 80114 - DNA, 449 bp, Zea mays
  unsure at all n locations
  Clone ID: LIB3088-005-Q1-K1-H5
cccacgcgtccggtggaccgccaaggagctgctggatcagtacctcaagttcaggcaggaggccgaggagggtgactgcaagaaggggaggaagaagaagagcaagaaggacaaggacccctccaagcccaagcagcccatgtcggcctacttcgtgtactcgcaggagaggcgtgccacgctggtcgcggagaagaagaatgtacctgagattggcaagatcaccggggaagaatggaagaacatgacagaaggtcagagggctccctatgaagaggtcgcgaggaagcagaaggaagagtaccacaagcagatggaggtgtacaagcagaagaaggctgangaagctgctagtcttgagaaggaagagcaggagcataagaaaatcatgaagcatgaggctctccagctgctcaagaagaaggagaaggcagataatatcatcaaga

SEQ ID NO: 80115 - DNA, 290 bp, Zea mays
  Clone ID: LIB3088-005-Q1-K1-H6
gctgcccgcctctatgtggagaggatagaagaacttgttggtgttcccgtgcactacattggtgttggacctggcagagatgctctcatatacaagtaaaagcaactttatttggtccttggttgggcggaaacctggccgggactcgggagcatttgcattttcttggcgtggtagcttttgatacggtgaagtcactgactcgtggagtgatgttgctcaataatcagaaccttgttctaatacagccgctgagacatcagctaaggcgaataagggaaggatgagtc

SEQ ID NO: 80116 - DNA, 350 bp, Zea mays
  Clone ID: LIB3088-006-Q1-K1-A10
cctacgcgtccacagacgcgtcggcagctcaaggcctctggccatatcggtgactctgtcgacaaacctttgcgcgggaagggccaccaggcagacatcgaggagttcttgaaggtagcctttgcgtgcacccagcctcgcgtgagggagaggcactccatgtaccgcatctaccactccctgaagagcatcggataaggccgcgacgccacggagcagttcgacgagttcccgctggcctataacaaggacgattcggacactatgtagctagctgacgctgatcaccgattggattgtgggaatgtttttttgtcaggctcgtcgatgattatatatattatatgtgt

SEQ ID NO: 80117 - DNA, 398 bp, Zea mays
  Clone ID: LIB3088-006-Q1-K1-A11
gcaaaggcgctaatgaggtcagcatcatcatcgaggcttacaggaccttgagggaccggggcccttatcctgcagatcaggttgtgagagacataagtgggaaatttgcatttgtcctgtatgattgctccactaagtcggtcttcatggctgctatgcagctgttcagttattccgaagacatctatctgatcaaaggctactgctacgacgtacaatggtacccactggtattgacagggcaactgataggtagctcgtgttcataaacctcataacaggaccccgatggaaatgttccgttctactggggcgttgacaccggcgggcgtcttgtggtctctgacgacgccgagctcgtgaagagtgcctgtgggaaatcctgtgccccgttcccc

SEQ ID NO: 80118 - DNA, 383 bp, Zea mays
  Clone ID: LIB3088-006-Q1-K1-A12
gtctcgtacagcccttctttcttccatctcccggagcagcacgtagacattcagctgccgcaccatttccagcagcctccgcggaacgtccagatgctgtcccaccccaactccctctcggatatggcgcagcaagactcgcttgggcggctccgggggctggacattggaaaagggtccatggctatgaagccagaggcagaggtcgtggtggtgaagtcagagggcagctctgtatctgcaggtgaaagcaacaccaccttctagctatacaatacatctgccttccaagaagcctccgtttggtttagagttcttttgttcatagtctgacatcctccttccttgagctgcttcgtccttctcagtaagcctattttttt

SEQ ID NO: 80119 - DNA, 392 bp, Zea mays
  Clone ID: LIB3088-006-Q1-K1-A2
tccggcctacgacgtacgcgtaaaacatgccgaaagccacatataaactttacatgtgcgtgtcagttacaaatatcataccaaatttggaagatcgggataagatctcaagctatactgtcgacaagaatgggaagaagatacagaagttcgagtttgagaagacgacgccaccagttgagatctgtaacacgctttggaaaacaatttagggccgtgcagatcgttgttactgtctgttaacgaagattgtcaattgtacttgtatatatagctgactagctgaggatggtggacctctcatcttcaattgtgcttgaatttagggcgtgcaaaccgtcattagtgtctgctgattttacagtgttttgatttcagtcagtataagatcg

SEQ ID NO: 80120 - DNA, 285 bp, Zea mays
  Clone ID: LIB3088-006-Q1-K1-A3
gccacgcgtacgagcttggaactcacatgggggctatgacggagagagaggagatgctgggcgtcctcacgacggtgagatccgttgcttcacacactgacatgacgtatttctgcatttcaagttcatgaatgtggcagccagagattatcaactgtgttttttccctacggtctagaaacttgacatggccaagtttttttgaccgagacatcgattgttagtaatgtatatgaaccaccttgaggtattttgcctcaacttccaatgcatcaatggtttgtt

SEQ ID NO: 80121 - DNA, 383 bp, Zea mays
  Clone ID: LIB3088-006-Q1-K1-A5
cgccaagattgtaggccggctcgggcttgataaaaccatgtttgaagcttccaactgcaacacctcggagtggttcgtcagacgttatggcccaagggtaaatctctttgttgaacactctgacgtgatgaatctggagcgcctccggggcttcaacatgcgcagaagcaactcggcctcccgttttgcctcgccgttcttcctgatctaatgggctaatggccattccccttcctgagatgtgtaagatacttctacatgttctcaccctcgcagagcttgttatggcctagagatgtaaccgcctttgttaatgcctcgatgtagcccccagcgagcagcgcatagcacctgttatgttgtcagcgtcgctactgataatc

SEQ ID NO: 80122 - DNA, 242 bp, Zea mays
  Clone ID: LIB3088-006-Q1-K1-A6
gcgtccgcgccaagatgtaggccggctcgggcttgataaaaccatttttaaatcttcgaactgcaacaactggggggggggcgtcagactttatggcccaaggataaatctcttagttgaacactctgacgtgatgaatctggagcgcctatggtgctttaatatgcgcataatctacttgaccttactttttgtctagctgatctttctaatctataagtataaatgccattccccttcat

SEQ ID NO: 80123 - DNA, 445 bp, Zea mays
  Clone ID: LIB3088-005-Q1-K1-H1
cccacgcgtccggcaaaagcccaacaacgactcatagacaatctgcctgatgagtttgcaaaggtgcaacgggaataccatcttccgtcgggagattttccttatgtggagcacttcaaagaggtcttgagcggttacagctttgacaagtttgagaaggtgaagcccaagatgatacaggccgtggatgatatgcttggatatgacattcctgaacttctcaagaacttcagaaacccatacgagtgaacccatacaggcggttgaaagatgacttcgatctgcaacagaatgagggattgattgtcaggcgatgtgaatcatagtggtcaatgtctcttggggcgttcattgccatccatgcttagccattgctatataactttatgcataagaatcatagagccattgctcaagctttcaccagacatctgattatgtaaaa

SEQ ID NO: 80124 - DNA, 339 bp, Zea mays
  Clone ID: LIB3088-006-Q1-K1-A7
cccacgcgtccgattcggcatcacttgacaagaccgtgactgtatctatctacagggttccacatgcacattcagcgagtcaatcctgggatcgtgtggcttccatactgggctgttcacctcaccacatttgatggatgttagagagcgatttcagctagatggagaaaattttgaagtactcctggtggtgctagaacaagttgaagcctatttcaggttcctcgcgctgctcgcattcaagatattttctgctgagcaggtagatgttgctattctcgaggttggcctaggagggaagttcgatgcaactaatgtggttgttagttctcgtgaatg

SEQ ID NO: 80125 - DNA, 161 bp, Zea mays
  Clone ID: LIB3088-020-Q1-K1-E1
ggaggaggtccgcagacagttcaacaccattcctgggttgatggagggaactgccaagcctgactatgcaacctgtgtgaagatctccactgatgcttccaataaagagatgaatcctgctggtgctctggtcatgctcactcccctcattgttggaaccc

SEQ ID NO: 80126 - DNA, 393 bp, Zea mays
  Clone ID: LIB3088-020-Q1-K1-E10
caggacgttaaaactgatttgcgtttccagagccatgcggtgcttgccctccaggaggctgctgaggcataccgtgttggcctgtttgaggacaccaacctgtgcgccatccatgctaagcgtgtgaccatcatgccaaaggacattcagctggcaaggaggatccgcggcgagagggcctaatcgccacctcaaacatcgtgacaaaaacatgaagtcctggggttattgttaatctggtgccattgtaaggacatatgagtagggtttgttttgtggatcgcaagtttctcttctgctactgttgctgctacctttgctggtgttattgctagggtcgaatacttaagttaactatgcgctgacagtctggactagcagtgttatgtgcgc

SEQ ID NO: 80127 - DNA, 436 bp, Zea mays
  Clone ID: LIB3088-020-Q1-K1-E12
gcgaaaattgctttgagacgtgaaaggattggtgcatcagcccgtttctggcgattttctggtgcttcttacccagacctgatagaggcgttgccgaaaaatccacttacatctgtaaataggacagttaatggcagttttggtcaaccatccaatgctgggggtgatgtttatcctgtggaatcttacgagagcttatcagtgaaccatgtacttgatgctcattggggtgttctggatgatgatgatgcgactggacttcgctcgcatactctctccatccttgtgaatgactgtcctggtgtcctcaacattgtaacaggagtctttgctcgcaggggctacaatatacagagccttgctgttggcccagctgagaaggaaggcatttcgcggattacaacagttgttcctggtactgttgaatccattgaga

SEQ ID NO: 80128 - DNA, 178 bp, Zea mays
  Clone ID: LIB3088-020-Q1-K1-E2
cccacgcgtccgcccacgcgtccgcggcaacggatatctcggctctcgcatcgatgaagaacgtatcaaaatgcgatacctggtgtgaattgcagaatcccgcgaaccatcgagtttttgaacgcaagttgcgcccgaagccttctggcggagggcacgtctgcctgggcgtcacgcc

SEQ ID NO: 80129 - DNA, 443 bp, Zea mays
  unsure at all n locations
  Clone ID: LIB3088-020-Q1-K1-E3
cccacgcgtccgatgcacaatgctttggtggctcaccgaagctatgagaacttgaagggcataatgccaaacatggcactgcttgggcgcacctttgcgaataagagcatggagtggccagagtttcagcaggttgtacaggcaggacacaaaggaagatacgggcaaatccggttgagaaaggcaacgcaatccatctacacttatcctgcacctgactgtatgtgccaaggataggctactggtttcaaaatttcagaaaaccaatcggttctgcagcaaatgaaggtcgaggatcgccgtctcaaatgttgcattgcggttagtacattccagctgccactagatatgcaagtttgatttttttgggacagctgctatgtactggatctnctctctctctctctctctctctctctctctctcttcacaatacagtttgg

SEQ ID NO: 80130 - DNA, 400 bp, Zea mays
  Clone ID: LIB3088-020-Q1-K1-E4
aggctgctgaagcatacgtggttggcctgtgtggaggacaccaaccttttctccatccatgctaagcgtgtgaccatcatgccaaaggacattcagctggcaaggaggatccgcggcgagagggcctaatcgccacctcaaacatcgtgacaaaaacatgaagtcctggggttattggtaatctggtgccattgtaaggacatattagtagggtttgttttgtggatcgcaagtttctcttctgctactgttgctgctacctttgctggtgttattgctagggtcgaatacttaagttaactatgcgctgacagtctggactagcaatgttatgtgcgctgctggaccttgcgcgcaatgctgtggccgatttgttcgttaatgtcaagaattgtgttaa

SEQ ID NO: 80131 - DNA, 271 bp, Zea mays
  Clone ID: LIB3088-020-Q1-K1-E5
ccctctgcaccgtcttataagtaacttggatgacaaggttcctgagagggttctatatgaaattcttattcaggtaggtcgtgttgtagacctacacatacctcgtgacaaggaaactagccgaccaaaaggttatgcttttgctgagtatgaaacagaggagattgcccagtatgccattaagctattttctggccttgttcgacttcataataaaacacttagatttgcggtgcgtttccctttgctctctcattttacataagttata

SEQ ID NO: 80132 - DNA, 297 bp, Zea mays
  unsure at all n locations
  Clone ID: LIB3088-020-Q1-K1-E7
caccgcgctgcacattaagcttcgtgcaactggtaggcaacaagaccaagacccctggacctggtgctcagtctgctctcagggctcttgctcgttctgggatgaaaattggacgcattgaggatgttaccccggttcccactgacagcactctcgtttgtgaataccttgtggatccgacagtcaattttgtgccgtaaattaattgttaatttgctgcttcgagtanaaaaaaaaaataaaaaaaaaaaacattaaaaataaatacaaattgaacaacaatcaaaaaaaaacaaa

SEQ ID NO: 80133 - DNA, 376 bp, Zea mays
  Clone ID: LIB3088-020-Q1-K1-E8
cctcccgggggaatgttgccccttctcaaggtgatgacatggagacgatgccctctgctctgacagggcgtcttctaggcaaaggaactgctcctgctcctagccctcctgacagtcaagagaagccatccatcatgcatgattctgagacaggtatggaggttgataaagttatcgatgatattcatggggatggtagggtgagctctattcttggcaccaaactttatgttgctgcaagtgatggggattctgaagctttgttggtggaaagtagggtaaatttaagtcggatacctaattccccagaaagtacacattgaacaccttttattccattttaatttctttttgtctgagggtcttctgccctcag

SEQ ID NO: 80134 - DNA, 423 bp, Zea mays
  unsure at all n locations
  Clone ID: LIB3088-020-Q1-K1-E9
ccttccggctggtggtttcagactggacacgccgattcatcttcggaagagactcgagttgcatatgatcaagagggaaaagattttgctgtgacatatattcagatgaacggggccagtacagcctcttcccacttttttttagtctgatttcacataaatgttccccttttgttgttagggaagaatctgacttcccctgcactttgtatagtgcaccacgaagaaattcctttgtacctaccttttctttttgagagagttgcactgcacttttgcggtctgagtaagctcagaattcttttaatagctattttttctaccactaatatgtgatatggagaagggtcagtttggacctgattttgttgtgtgnnaaaaaaaaaaaaaaaaaaaaaaaatttttttttttttttttttttt

SEQ ID NO: 80135 - DNA, 396 bp, Zea mays
  Clone ID: LIB3088-020-Q1-K1-F10
gttgtgagccatactgtgcccattaatgaaggatatccccttcctcatcctattctacgtctggatcttgctggtcgggacctcaccgactcgctcatgaaaattctcactgagaggggttattccttcacaacctccgccgagcgagaaattgtaagggacatcaaggagaagcttgcgtatatagctcttgactacgagcaagagttggagactgccaagaacagctcctcagttgaaaagagctatgagctacctgatggccaagtaatcaccatcggtgcagagagattcaggtgccccgaggtcctcttccagccatccatgattggtatggaggctgctggaatccatgagacaacatacaattcaatcatgaagtgtgatgtggatatc

SEQ ID NO: 80136 - DNA, 431 bp, Zea mays
  Clone ID: LIB3088-020-Q1-K1-F12
taaacccttgcaatctgagaggcaacaattaatctctgtttccaataggcggcttgaaagagcacggcttgatcagagtcaaccaaattatcagacagatgcggcacctggttgtgcacagtctgcagaactctttccagtgacgtcaatgatgtttaatcacgcacctattgattctgaaccactgaaaaatgagttgcacaaattacgattacacatggacacactcaataaagtccatgaaatgaagaaaacccaacttcagaccgcatgtagccaagaactagagaaggtaaagagaaaatatgatttgttaattaaagaacatgattccactcatcttcagcaaaagaaggcacttggtgatttttatgagaaagttcagcgcaaccaatcgctggctgaggattttcgggccaaattcatatcac

SEQ ID NO: 80137 - DNA, 206 bp, Zea mays
  Clone ID: LIB3088-020-Q1-K1-F2
aaaagatgtattgcaagctatagtcgatttatcagtagcacaacataaccctctgatatgttcgtggtttatgcgtggtttctgaattgtagacttctgcgttgaagctcgtgctactgtttgttttccattgtttgttcacaccaacagctatatgcagatacatggcttctcagtgttacgccggcagatgaataagcttgggg

SEQ ID NO: 80138 - DNA, 188 bp, Zea mays
  Clone ID: LIB3088-020-Q1-K1-F3
cggacgcgtgggcggacgcgtgggattgaaggtcgctctgtgtcagttgttagtgcggtggtcatcctcggcggcagcagacccatgcatcaaccagcatggactgcggatcgatgggtgctgttacccccgtcaggctttattctaagttaaatcctaaggaaaaaaatggtgcttcttggtgctgc

SEQ ID NO: 80139 - DNA, 373 bp, Zea mays
  Clone ID: LIB3088-020-Q1-K1-F4
cccactcgtccgcccacgcgtccgtaacgatgtaatggagtatggtggttcccccaggggagagttccagcgcgtgcattcgacttggtcgtaaagacatgttggattggtcgtttggtgaggaggctggtccagatgaaggcaagctcttggatcaccagcccttacggcttaacaatgatgattatgagcgggttaagcaaattcctgtcaagaagggagccaacttccgtgacctaaagggtgtcaaggttggagcaaataatgttgttgagtgggatccagaagtcgaacgtgtgtacctttcgtctgggaaaccactggttcctgactatgcgatgtcattcatcaagggcaaatcactcaagccatt

SEQ ID NO: 80140 - DNA, 269 bp, Zea mays
  unsure at all n locations
  Clone ID: LIB3088-020-Q1-K1-F6
cggacgcgtgggtaaaaaatataaaaatatttatttcaaaaaataatctataattacaataagctgtnttttaaaagagggaagggggcacaaacataccaaattatcaaacatattacagtgcctccttattcacattctaccagccctctttttacaaactttgccacttttttaatcccctccgtccccaaattaaaacacctttcaccacatatctcttttttcctccaacttaaatacctattaggcccccacctttttacctt

SEQ ID NO: 80141 - DNA, 362 bp, Zea mays
  Clone ID: LIB3088-020-Q1-K1-D9
tttccgggttggacgaagccttccgccaacccttccgccaacccttccgcccacccgtccggccaaccccaccctaccgtgagtgaagccctcaaagaggcttgcttgcaaaccttcgataaagcaatccacatataatttctcattttttgtgtccaaactccaaagtttgtggtaattttgggtctgttggaaaaaaggcccctgattgtcattttgtttttgtcggccatactgtgaattgaccctttgagttgtccatcttagcggggttttgtgcttccttggcttggtttatccatccaaataataacctgatactatgttttacattttatgcccatgaaccattgatggatatc

SEQ ID NO: 80142 - DNA, 290 bp, Zea mays
  Clone ID: LIB3088-020-Q1-K1-F7
caagagcatcgcccggccgcggcggcccttaatcacgaggccgccgagtgctccggatgggacgcgctcccggggtgatggtggcacggcgtgtcggcggcgtacgacgaggcccccgcgccgcgcccggccttcgacttcgacgcgcggccggagagcgccacggacgaggcgtctccccgggcctccgactccgagtcggacgcgctgttcgactcgctcctcttctgcgaccagttcgccttcttcgacgccggcgcgtacgagtcgctggacagcctgttcagcgc

SEQ ID NO: 80143 - DNA, 84 bp, Zea mays
  unsure at all n locations
  Clone ID: LIB3088-020-Q1-K1-F8
tcccacgcgtcctcccacgcgtcctcccactcgtccgnaaaaaaaaaaaaaaaaaaaaaagggggggaataatagggggggaag

SEQ ID NO: 80144 - DNA, 438 bp, Zea mays
  Clone ID: LIB3088-020-Q1-K1-F9
gcctaactgcagtgttatttcatgagcagtaaataaaatttgtgtcgaatagtatgtgatgtcgtatcactttcaagtgtcttgaatggactacataataggttctcctaagtcacatactcacattgtatacatttaccttacagagtcttacttatgttggtactaatcaaggatcttttatatgtaactccaacgccttgcctttgttggaggcaagggtatttcacatgtttcaaattgccatgctgaaggagctaacgaaaaccaactgtgttccacagatattagaacctttgagatccttcttcgcacgtatgaagtacgagacgttgctctgaagagcctcacctccgatgaggcttatgtggggcctcttccgcagaaaagaagaatgcccacaaccccaggtgaaaacacggactgcccacaaaggac

SEQ ID NO: 80145 - DNA, 428 bp, Zea mays
  Clone ID: LIB3088-020-Q1-K1-C3
cggacgcgtgggcagccggctccgcctccttcagcagccacaccccgtccgtcaccagaggaagaggaagaggaggatgtcggggtcgaaggtgtacacccttgaggaggtggccaagcacaacaccaaggatgactgctggctcgtcatcggcggcaaggtgtacaatgtgaccaagtttctggaggaccaccctggaggtgatgatgtcctgctgtcttccactgccaaggatgctaccgatgatttcgaagatgtggggcacagcaccaccgcccgtgcaatgatggacgagtacctcgtcggtgagattgatgcggccacgatacccagtaaggtgaagtacacgccccccaagcagccgcactacaaccaggataagaccccgagttcgtcatcaagatccctcagttttggtccccctggca

SEQ ID NO: 80146 - DNA, 368 bp, Zea mays
  Clone ID: LIB3088-020-Q1-K1-C4
gcacaacctcagattacacagcgaagaaggcatttctgaatgtcttgatagcttcaaatggatacattgtaatattgtggtaacaccaatttcattaggctgaccattcttttcctcgcgagatgctcttttgcctactaggaatgctgataactgagcttcccagcctcttctataatcatataccgcgcggtggcaaactagcctcgttcgggtactggctttctgctctattagcatactggtctagtggatcaaccgagaaaagctatcaacaatcttagtactaacaatctatggtctgaagactcgtcttctttaagtgttttgttgtatagcgcagctgctttttgtacaaatgaatgttt

SEQ ID NO: 80147 - DNA, 396 bp, Zea mays
  Clone ID: LIB3088-020-Q1-K1-C5
ctgacgcgtgggggcgaagtctcttctcatgtgatgctatgctttatatattagggtgacgatggagtatctataactgtgtctggatgacacagttttttttggttagcagtggacccaaaaaaaatgtctgaaatctttgaatgtgtagaatggcatgttgtgtccaaaattttcatttgtaagccttcaaagttgtgtagcatgttttttcttctaattttgactggtttagttatcggtcgttttgtttaatctcttcctgttggaaacggtaaaatagcatgcttgatggcatgttgtaacttaacaaattagggctacactttgtttaagatggtaatatgtctccctgaaaccaaaacattattggaatctgccaaaaattcaccttac

SEQ ID NO: 80148 - DNA, 384 bp, Zea mays
  Clone ID: LIB3088-020-Q1-K1-C8
ggaacacatagatttctttggtggaggaaggaggagggcaacaagaggaggttacaggtggcccaatagatctactggtgttgagggagttgatgcaaagctgagttgctgcgcgttggctttctttagagatggcttcagctggtgttgccccttctgggtacaagaacagcatcagcaccagcattggtgccgaaaagttgcaagatcacatgaacgagctaaagattagagatgataaggaagttgaagcaaccataattaatgggaaagggaccgaaactgggcacataattgtcaccactactggtggcaagaatggtcaaccaaaacagacagtgtgctacatggctgagcgcattgtaggtcaaagttcttttggga

SEQ ID NO: 80149 - DNA, 424 bp, Zea mays
  Clone ID: LIB3088-020-Q1-K1-C9
cccacgcgtccggagcgcatacatgcccgcggacctgttggagttgatggacttctaactacgcgctgcattttgcgcggtagtggacaagtggtgaatggtgacaagggagtggtttacacccacaaggatcttcctttgcaatgaggcaaataacctccgttgtggtcgtaacgaatggctggactccccttttaagtacccttttcttttattccatgctacaaagtttggtgtcgtaacaagcagaatgcctatttagtaggcattgatgtaatcagaccattttgtcgtggtgttccttgtcgtataaaacatccgagacatctgtattagaggcgcggtagctagttgatacgcgattgttctggatgaaatttggatctgttccaaatgcatgataatgcatgtgtgatgaggtcct

SEQ ID NO: 80150 - DNA, 352 bp, Zea mays
  Clone ID: LIB3088-020-Q1-K1-D1
gaggaaggcaagtgaagtgatgcaccaccaccttgttactggcaggattgaatcctgaggaaagctccatatggatccgtgtatcgtctaggagaagtttatatccgtgtgctttgctgacactcgagggaggagaactaatatctgcactttattgtaccttaaatgatagccatgtttttattgtgaacctgtagtatgttgctaggcagtcagtttgaacattacaaatagcgtaagggcctctagccgggttggttaggtagtctgagtagcacttcctcatgtcctggttgtgggagcgaatgtcagactgtggttaaaaaaaatatcccatcgtttgtcccacgcc

SEQ ID NO: 80151 - DNA, 282 bp, Zea mays
  Clone ID: LIB3088-020-Q1-K1-D10
ttcctcccacccttcccttcttcaaggccatctttatttgtgcacccgcaacggctccacctgcggggttttcaagggggctgactgcggacagctctcctaaatctctctgatctggtctgttcagccgccctccctccttcatcttcaactccccctgcgtccgttcctttggatctgaataagatggtggtgatctgagtggtggccttagtttatcatgtatcgctcgcaatttaatttaaccgtttaagtgtgtatctgttaaccccatatcccctc

SEQ ID NO: 80152 - DNA, 446 bp, Zea mays
  Clone ID: LIB3088-020-Q1-K1-D11
tccggattgatgaaccatttattcagaacaagctatcaaaatttaagaacccgagagatcctagctggttggcggttgtggctgaaggcacggattatactgagaagaaatgcatcatgagtcaagagtatgcttcagaacatggcttgcctatgctagaacatgtcctccttccaaagacaaagggcttcatttgttgtttgcaagagctgaggagttccttagatgcagtttatgatgtcacaatagcatacaagcatcgactcccagattttctggacaatgtgtatggcgttgatccttctgaagtccacatccacgtcagaatggttcagctccatcacatccccacaacagaagacaagataacagaatggatggtagagaggtttaggcagaaggaccagctcctggcagatttcttcatgaaggggcactttcctgat

SEQ ID NO: 80153 - DNA, 438 bp, Zea mays
  Clone ID: LIB3088-020-Q1-K1-D12
gtgttagatctctcaacaataagattgatgcaatccaaatgccaacagaccatatcttctgatggtatttttggcgccgtgatgaaccaactgccattctatagaaatgaaaggccccatgtgaaccaaacaccatatgtaacccgggtgagccaaacaccggtagcatccattgcgaaccaaagaccagtagcaaaaggaaggcacctggtgagccaaacaccatcagcaaatgggaaacctctgacgaaccaaacatcagtagcaaatggaagatccctgatgagccaagtaccatcagcaaatgggaaacctctgacgaaccaaatagcattgccaaatggaagacccatgatgaggcagaaaacagcataatgaggaaggccccatatgaaccaaatacctgtatcatatggatggccccatacaaacaaaata

SEQ ID NO: 80154 - DNA, 121 bp, Zea mays
  unsure at all n locations
  Clone ID: LIB3088-020-Q1-K1-D2
naaaaaaaaaaaaaaacaaaaaaaatttttataaaaaaaaaaaaaaaaaaaatggggattataaaaaggggggcggtcttataaccaacttaactccgcccccccctaaaacccctctttt

SEQ ID NO: 80155 - DNA, 443 bp, Zea mays
  Clone ID: LIB3088-020-Q1-K1-D3
ctgcccacaaggtgattctttcagcccggtctcctgtttttagggcacaactttttggcgcaatgaaggataaggacatgaagtgtataaagattgaagacatggaggctccagtattcaaggccttgctccatttcatgtattgggatgagttgccggatattgaagagcttactggtgtaaatacaacttgggtatccaccttgatggctcaacatttactagctgctgcagaccgttatgcattggagagattgaagttgctctgtgaacttaagctgtgtgaagatgttgcaataaatacagtggaaaatactttggcactggctgaacagcaccactgttatcagctaaaaactgtttgcttgaaatttgtagctctgcctgaaaatttgaaagctgtcatgcaaaccgatgggtttgattatttgcaacaaagctgc

SEQ ID NO: 80156 - DNA, 371 bp, Zea mays
  unsure at all n locations
  Clone ID: LIB3088-020-Q1-K1-D4
cggacgcgtggggatttggagaaggcaagagaaatattaactgtgctgcatgagcagtgagatgctgtcattcatctagagtcaatttttccatgcgaaaagcgtattgattttttagactcacttgtggagaagtttgttacacctgaatcatctcagggagaggtggcaagtctagttgacaaagaggaaatatcttccatatttttagagtttttggatctctttggggctgttggaataagtgatattttagagtagttaatactagtagctagggtcaggatttacatgtttatttgcaatatgtcgacgccaaaggattcggtctttatactgataataaaccgctattggtttnaaaataaaaa

SEQ ID NO: 80157 - DNA, 278 bp, Zea mays
  Clone ID: LIB3088-020-Q1-K1-D5
ctgtaaactgatttgctccatcaccatgttttgtttacatatgaaccctactcaacggggtctctatacaaggtgagtgcgtatgttcaatgctgctttcatcatacttatcatctcttctatttctttcaccatcctccctcccctaattatttaaaccctcttttttgttaaaactctatctggtgttcttgccttaaccctgttttcttgagtgcacattgccatctcttcttccaacacctttgttgcattatacaattctaataagctcattt

SEQ ID NO: 80158 - DNA, 421 bp, Zea mays
  Clone ID: LIB3088-020-Q1-K1-D6
aatcctcttcctcgagttctcctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcggtggcggtcgtg

SEQ ID NO: 80159 - DNA, 237 bp, Zea mays
  unsure at all n locations
  Clone ID: LIB3088-020-Q1-K1-D7
gcaagggactgccctagcgccgacggcggaggcggctatggcggatgcggctacggtggcggcggctacngaggaggaggaggaggcggtggctgcttcaagtgcggcgagcctggccacatggccagggactgctccagcggcggcggcggctactgcggtggcggcggcggtggtggtggcggctgctacaactgcggccaggccggccacatggccagggacttgccaagcggt

SEQ ID NO: 80160 - DNA, 392 bp, Zea mays
  unsure at all n locations
  Clone ID: LIB3088-020-Q1-K1-D8
cctctccatccagagcctgctcggagagccgaacaacgactcgccgctcaacacgcaggcggcggctctttgggcgaaccaggaagagttcaggaagatggtggagaagctctacaaggccgccgcgtataagacagcacacggcgcagatgccgcctcaggttcttcaagcaccgatctcacttggatcgattgacgtggatggttttgtttggttgggttcccagtctggtactgtagcggtgtatcatgagcgcgtgggtagccttgagcctggcgattctgtaattgtcctcttctgaaatgttgagagattcatttttaaaaaaaaaaaanaaaaaaaatatttttaatttaaattaatttatttatatataaatttatttattata

SEQ ID NO: 80161 - DNA, 388 bp, Zea mays
  Clone ID: LIB3088-020-Q1-K1-C2
tccaagctagtagctgtagaaagaagaacacctggtgtaaaggtctgaaccgtgctggtgtcacggcgtggcctagcgacattctcgccacgctccgcatgtaacgttctcgcgcaaaaggcgggcacgacgcagcgtgagcgggtgtggcggggaaagcggatcgcattctgttgtgaacatcagaggaataaaggagaaagtgcagggcgcagttgcgcagtctgcggcaaagtattttctgcgcgttccgtagcctctgctctgtccagtttttccgtcaggtgaaaacagagtagccactgatcgctgtcgagcttcccattccggtggccggcgccaacagggaaggtgcacttgtagtagctgcgcgggttctcgctcccct

SEQ ID NO: 80162 - DNA, 135 bp, Zea mays
  Clone ID: LIB3088-020-Q1-K1-A2
cggacgcgtgggtgtagttccaaggcaggtgtaatccttagaaacatctcttggagagcttctagccttggagcactcgatatctgccattcaagaagagtcagagattcttcacctacccatgatattggtgct

SEQ ID NO: 80163 - DNA, 157 bp, Zea mays
  Clone ID: LIB3088-020-Q1-K1-A3
aaaaaaaaaaaaaaaaaaaaaataatctttttttaaaaaaaacaataaaaaaaaacaagaggacctttttaaaaaaggtgcggcgcccccttttatatttttcacctttcaatgagatccttttcaccttttattaaccttttttttgcccttcttt

SEQ ID NO: 80164 - DNA, 395 bp, Zea mays
  Clone ID: LIB3088-020-Q1-K1-A4
aaggaatccaagttgaaggcttcaagaatgcacatttatgtccgccgaggtggtccaagtgaccaatctggactggctaaaatgcgtaagcttggtgcataactcggcgttccaattgaggtgtatgggccagaagcgactatgactggaatctgcaaacaagcaattgaatgcatcatggctgcagcgtaatcagagcgtagctctgggtagtttgggatctgcaaacacgcaattgaatgtgtcatggactcagcataaatgagagatggatagtagttgcattatatagttcacacatggtgtttctgttttttgtttcagatatgttgtagcgtgttgtttgaacgaaaccttcacagatcattactgcaaagaaattgctgtgtgttaaa

SEQ ID NO: 80165 - DNA, 164 bp, Zea mays
  unsure at all n locations
  Clone ID: LIB3088-020-Q1-K1-A5
aaaacctttcacccatcttccccaccttcttctattttttaaatttttcccccgcannctacccccccttgttttttttaaaaaaaaaaccccctttccctcttattttctttactctctaattcttttcattcatcatcttctacctaataaacccctaaaat

SEQ ID NO: 80166 - DNA, 137 bp, Zea mays
  Clone ID: LIB3088-020-Q1-K1-A6
ccgcccacccttccgaaattttgccttggcggccgccactgccgattcaagttttgcaaacggttccttcttctttgcggttcggattggccccaccaaacaaaacgggccccaattcaaccggcggcaaggccccc

SEQ ID NO: 80167 - DNA, 298 bp, Zea mays
  Clone ID: LIB3088-020-Q1-K1-A7
cggacgcgtgggcagcccgtcacctaccattcgacccgccgcgacgctccctgctcggaacagcctgcgttgctcgcccacacgacgccacgcatgcaggaggagccagggcgtcgtcccgtgccgccgttcgcgggcgtggacctccgccgccccaagggctaccccgtggcggttgccaaagaggagaggccggcgccgggcggcgacccgtgcccgcggtgcgggtcgcgggacaccaagttctgctactacaacaactacaacacgtcgcagccgcgccacttgtgcaagtcgt

SEQ ID NO: 80168 - DNA, 420 bp, Zea mays
  Clone ID: LIB3088-020-Q1-K1-A8
cccacgcgtccgcccacgcgtccggcaacatcggcctcgacgacgtcgtcgagatcgccaggaccatgatgaacaggtccatggccaaggagttggccggcaccgtcaaggagatcctcggcacctgcgtcagcgtcgggtgcaccgtcgacggcaaggaccccaaggacctgcagcaggagattgatgacggagaggtcgagatcccgtccgcttgaagccatccaaggggacttccattggtgctgctgaagtgttgttgttctgcatgctatcgatgtacctttttcaagcaacgcgagccatctattttttttgtctagctatgttagtgatatctggtgagagacctcaatgttaccaccgtattcttgtctttggtggatggagagatttaagcacctcacacacctttgtctt

SEQ ID NO: 80169 - DNA, 324 bp, Zea mays
  Clone ID: LIB3088-020-Q1-K1-B1
aaaaaaaaaaaaaaaaaaaaaaaaagaaaaaaaaaaaaaaaaaaaaaaaaaaaaaaagggaggaaataaaggggcgccggtcgcgacctaggttcgtttgtccctctcctttcgaggtattaccagtcgaccggttcctcggagcacaataaagtttgttgctgcctacctgcttgctgtcctcgctggaaaccccagcccctccgctgacaatttgactgccattctggagtcagttgactgtgaagttgacaatgaaaagatggaactcctgctgtcccaacttagcggtaaggacataaccgagctcattgccggcggcag

SEQ ID NO: 80170 - DNA, 434 bp, Zea mays
  Clone ID: LIB3088-020-Q1-K1-B10
cgcaaagctcgataaaaatgaggtaatgaaagctgctgcaaaagctcgggcatcatcctcgggtctgcgaccaatggatgcccgtcgtggtcatgaagctgatgtcatctccagcgacaatgccagtgtcaggagcggcatgagtggtgactacagcggcacaaaggaatcaaacatcgagatgaaactttctccacttcagaactcatacccccaaagccttgcaagccaggatgaatatgataccggcacaccaaccgcaagcagtctaagcagtccggtctacatccacaagcttgcctctcactctcagttcagtgcagcgcctcgccctgcgcctcctgaaagatttgtgccagctatggtacggccacccgttcctaccacacaaataaccaacccagggataccgctgccagctgttcccacaacac

SEQ ID NO: 80171 - DNA, 319 bp, Zea mays
  Clone ID: LIB3088-020-Q1-K1-B11
cgtccgcttcggcctaagctgccaatcagctgatcaattctaccaaggaatcatccaacacatgcgggctcaagataactggggaaggggagcgttttaccaagaccaacccttatactgcccttgtatactgctgcactcctcactaaaaacctttacctccataacagatatatatatctatcgtgtactaacttctaacatttttttagctttggaactaacagacacttgtattatagtgcataaaatacctatccccctccgtggccatataacccttaagtcgatctatcttttaatgaggcgtttgacgtaa

SEQ ID NO: 80172 - DNA, 235 bp, Zea mays
  Clone ID: LIB3088-020-Q1-K1-B12
gctgaatgttgtgcgggaggcgttttcccccgttattagtagcgatctgcgtgctatatatggtcgctgaagtcaaaattggctctcttttattttttatctactactactactcatttgcgagtgagagatggtctgggcacaccattcaattgcaacggcctactggtgtgttgccccccaatgagggctgtgacgattgcgccactacctcgtgagaaacatgatgtgaccg

SEQ ID NO: 80173 - DNA, 153 bp, Zea mays
  Clone ID: LIB3088-020-Q1-K1-B2
cgccgtctccgagggaaccaaggccgtcaccaagttcaccagcaattgagcagcctgcagcgtccacggatttggtaggtctccccttcttacaagggttcttcgtcgtgtcctctacccctcccctccccgcctatgtatgtgctgtgaaaa

SEQ ID NO: 80174 - DNA, 286 bp, Zea mays
  Clone ID: LIB3088-020-Q1-K1-B3
gattggagtacattatcagtatggtgctgattttatataaataataataattgttgctagtttatggtcaaaggaaaaaaaaaaaaaaaaaaaaaaaaaaaaaaaaaaaaaaaaaaaaaaaaaaaaaaaaaaaaaaaaaaagggcaaacaatcaaaaaaaaaaaaagttttagggcgccagcattaaaaaatcaaacttttctaacgcgtcaacgaaaatcaataaaattgccatggtttaacaaaaattaaaactattaaaacccctttttttaaccaacttaat

SEQ ID NO: 80175 - DNA, 373 bp, Zea mays
  Clone ID: LIB3088-020-Q1-K1-B5
gccgagtgccttgcagatgagctgatcatttctgccaagggctcatccaacagttacgcgatcaataagaaggaggagatggagcgtgttgccaaggccaaccgttgaactgagcttgtatcctggtgcactctgcgctggaaacttttatgtcgctggcagtcgtatcggttcttgttttaccaatgtttagagttttttgagacctatatgcggttttggttttcagtgcacaattaaaattactgagtaatgtagttgattgggaacagaaatgtttggtgcctggtttaccgaactccagttctcttgtcatttttctttattctatagtctgtattatgtatgcgtatgagtattgagatgattctgc

SEQ ID NO: 80176 - DNA, 171 bp, Zea mays
  Clone ID: LIB3088-020-Q1-K1-B6
ccggccaattgcccatttgcacctgtagtattagagaattagctgagatttccttttcaacttacattatgatccattatctcttcagctactgctagtgaaagagttgtttgggtcatgcccacaaactaagcatgtcacaggttcttaggcatatgtttttgttaggag

SEQ ID NO: 80177 - DNA, 350 bp, Zea mays
  Clone ID: LIB3088-020-Q1-K1-B7
cggacgcgtggggtcgattcgaagatttgccatcctactgagtttgacttctacctgtgtagccatgctggcattcagggaacgagccgccctgctcactaccatgtcctgtgggacgagaacaagttcacagctgacgagctgcagaccctgacgaataacctgtgctacacgtacgcctaggggcacccgttcggtgtcatcggggccccgggcgtactatgctaatcttgcagccttcagagctcgcttctacatggagccagacacctctgacagcgggtcactggccagcggtgcccgtggccccccaccaggtgcggcacgcatcacgagaggggcggggagtg

SEQ ID NO: 80178 - DNA, 291 bp, Zea mays
  unsure at all n locations
  Clone ID: LIB3088-020-Q1-K1-A12
cggtcgcgtgggggctgtggctcggcaccttctacaccgccgaggacgcggcgctcgcctacgacaaggcggccttccgcctccgcggcgacacggcgcgcctcaacttcccggccctccggcgcggcggcgcgcacctcgccggcccgctgnacgcgttcgtggacgccaagctgaccgccatctgccagtccctgtcggagtccaagtccaagagcggctcgtcgggcgacgagtcggccgcgtccccgccggactcccccaagtgctcggcgtcgacgacggaggggg

SEQ ID NO: 80179 - DNA, 355 bp, Zea mays
  unsure at all n locations
  Clone ID: LIB3088-020-Q1-K1-B9
ggacgccgcaggttgaggagagctatggatctggttacgggaggaagcctcaggttgaggagagctatggatctgggtacggcagcaggccgcanggtggggaggagtatggcagtggtgggtatgggaggaaggctcangaggagacctatggctcctcggggtatggctatggcaggaagaacgaggagcagagctatggtggttctggctatggttatgagaagaaggcatctgaggaggatgaaggtgcctttggctctggtggttaccggaagccaaaaccctatggcgaggagacacagggttcatacggttatggagaggaacagcccaagtatcagagtggcgggta

SEQ ID NO: 80180 - DNA, 357 bp, Zea mays
  unsure at all n locations
  Clone ID: LIB3088-020-Q1-K1-C1
ggaaaggatgctactgctaatttctggcgccatatgcggtgcccaagatgcctagatgatgctgttgagggcaaattgtccccttctatgctcgccaaccagatgaaaagacaggctgataatttcattagtctatattataaaggtttgcagatgtgtgacgatgagggttgcaaatactcgactcacagcgtaaaccttagagttatgggggattctgagagaagaactgtctgtcctaactacccacgctgcaacggtcgcctagtaagacagtacaaggagtcagatctgtacaggcaactatcatactnttgttatgtaccttgatgcaacccggtgtcttgaaaagctgga

SEQ ID NO: 80181 - DNA, 441 bp, Zea mays
  Clone ID: LIB3088-020-Q1-K1-C12
cggacgcgtgggcgagcatacgcgacgactgacaaggcgaggggagcactcggcggcgatgggcggcggcggcgcacatggcggcaccacctacaagggctacaccatcccgcacaacaagcgctggcacaccgtcgccggcaagggcctctgcgccgtgatgtggttctgggttttctacagggctaagcaggatggtgctacgctcttgggtttgcgtcatccttgggatggacatgatgaccactctcatggtcatggacacgggcatgaggcatcatcatcgtcatcttcacattaagttccttactggctgcggacgatgcttggcatgttccaacagctaaagtttgagttaataaattctatcaccctgcatgggactcatgttgtttgcaactggtttagcacgaactggtcttgttactattgtgctaatgt

SEQ ID NO: 80182 - DNA, 415 bp, Zea mays
  unsure at all n locations
  Clone ID: LIB3088-012-Q1-K1-G4
cgcccgagctccggggcctgctggcgtcgctgggcctggccaagtcggaggccgaggcgcgcgacatgctggcgcgcgccgacgccgaccgcgacggccgtctcagcgtcgaggagttcctggacgtgatgaacgccggggagctcggactgggcgcgctcggggcggtgctgcagtcggcgctccccacgctggaggccgcgggaggcgcgctggtcggcgcggacgagctcgcccgggcgctcggcgccctcggcagcgctagcgccgaggactgcgcggctattggtgagtgcctggacggcgacggcgacggcgccatcaccattgaggagttcaggctcatggccgacctgctctaggtctagctnggagctagcccangctgcgcacgtacgcacgcgtggaacaccat

SEQ ID NO: 80183 - DNA, 341 bp, Zea mays
  Clone ID: LIB3088-012-Q1-K1-G6
ggaggcccgtgctgtagatgcagcagagattactggtgagaaagaggtggccctctgctgtagatgcaacagaggagacagaagaaagcaccgaaggccaagcacagcctaataatgttgctgccccagaatctgagtataaaggagacggaaagccatgtgaatccgaagcagcttcccttgcatttgttgatgaagcagctccccatgtaattattgatgaagagaagaaagaggaaaatactgagaatgagaacagtcaggcagccgaatctgccgtgcctttcctggcatctttagagggagagaagaaagagaatggtggtgcccctgaacaacca

SEQ ID NO: 80184 - DNA, 76 bp, Zea mays
  Clone ID: LIB3088-012-Q1-K1-G7
aaaaaaaaaaaaaaaaaaaaaaaaaattttttaaaaaaaaaaaaaaaaaaaaaaaaaatgtaaaaattttaaaaaa

SEQ ID NO: 80185 - DNA, 287 bp, Zea mays
  unsure at all n locations
  Clone ID: LIB3088-012-Q1-K1-H10
cccacgcgtccgcggacgcgtgggctctctcctcggtttcctctcccaccaccaacgcgcgggatcgcagcgatctgcgccggcgccctctctgggattccgcgcgacaaagtcaggcgtagaggctccaggaggaggagggaggcgcagcagggcgggtgggggagatgttcctctgggactggttctacggngtgctggctctcctcggcctgtggcataaggaggccaagatcctatgtcttggccttaacaacgccggcaagaccacgctggtccacatgctc

SEQ ID NO: 80186 - DNA, 297 bp, Zea mays
  Clone ID: LIB3088-012-Q1-K1-H11
acgctattatgtcaccaaattaacgttgggtattgcggtgtggttagaggaatccatagcggttcgtctgccttgaatctgctgtcagttatagattcagattcagaaagctgaaagttagtttggtagtcttgaggggatgaattatgtcaagctagtttactggtgttaatgttgtaatttacactagcatgtttgtaattgacataactttatctaacttgaatatgcccttgggtaccttggatttgtgactatattattattggtctttgaatccttcattaatgtaccggt

SEQ ID NO: 80187 - DNA, 280 bp, Zea mays
  Clone ID: LIB3088-012-Q1-K1-H2
ttcgacttatctaacttgcctgtgggggtgtccatgcaagagggggtggacataaacctgacgctggaacaaatgacctctctattacaactttgtgctgttacttgtacatggctacgtctatctcgtcttatgctatcaaagacatcctgcttaaatttgcagactaaccgtatgctgcacatctagcaaacatgctcaagtatgcacgtcttaccacatttactcagttactctccaataaataatgctattcatgatgccgattacctgcttatct

SEQ ID NO: 80188 - DNA, 412 bp, Zea mays
  Clone ID: LIB3088-012-Q1-K1-H3
catcaatggaaatcgcattgagcctcggcgatattatgagttatttgaaaaggacacaatcaagtttggcaatagtagccgggagtatgttttgctccacgaaaattcaacagaatgagttttgagaaaattcaacagaatgaggattgaaacaatcagccttttatgctgtagaagaaaaatacagcaaaaacatgaggttttgcatgttttaaaatttttagactggagattggccggcttgaacttctggtctgtgatttcttcacgtgttcaagtctataaggatattttgtgaaccaacatgtagtgctattgtaatgaaaagagctagctgcctgtagcagatagccctggggtattggttgtattcaagcatgttttgcaccgcttgcattcacatcattcggta

SEQ ID NO: 80189 - DNA, 320 bp, Zea mays
  Clone ID: LIB3088-012-Q1-K1-H4
cccacgcgtccggcgccgggcgccgtcgacgcccccgaagacggcatgacggacggttcattccattctccagagtggcatgcggcgcgcctggccagccttaacaagacgcacaccctcacctgggaggagttcaagaagaagcagaaggaagaggaactgaaaaggggtgagctggaggctgacaaagacaaaatgatgagagagtatagagctcaactggatgctgaaagagctcaaaagctagcaaacggaagaaatcactcaaggtcaaactcaaaatcatcatcttccaagaaagagaggaaggataaggacgc

SEQ ID NO: 80190 - DNA, 243 bp, Zea mays
  Clone ID: LIB3088-012-Q1-K1-H6
gagacactcttgttctgcatggatatggagcccattaaagcaagtggggtgcttaggtctagttggtcttctgaacgagtgctttggactattctttagtggacttttcagagcacatgacttgagagctgacacaaagctcgttgcagatgtaattctgtctaggcaagatggaggaaaatgacctcacattgcggctgtaacatgtggtctctaactgggattgaaaccctacttattttt

SEQ ID NO: 80191 - DNA, 301 bp, Zea mays
  unsure at all n locations
  Clone ID: LIB3088-012-Q1-K1-H7
ccttccgcccacgcgtccgccatcttctggggcctaatgacgctcagcacgttcggcaacctgaagagcacgacggagtggctggagatcgggttcaacatcatcaccatcacgggcgggctcgtcctcgtcaccatgctcatcggcaacatcaaggtgttcctgaacgcgaccacgtccaaaaagcaggccatgcacacgcggctgcgcggcgtggagtggtggatgaagcgcangaaactgccgcggagctttcgcggtcggtgcgccagttcgagcgccagcngtgggccgcacgcgc

SEQ ID NO: 80192 - DNA, 315 bp, Zea mays
  Clone ID: LIB3088-012-Q1-K1-H8
ctggtgcagagcagaagcccagcagctgagctgatagtgtccctgaaattgctgtgagaccacctatgaaaaggatgctttgagtgcacatgtatagagttcttccctgaagcgattctttcactttcttttcttttgttttcttttttggttcctcctcaccatctccaccccacccgtccacttctgcgttccttcgatggatctggcgagcccgcggaataaatgagagttttggatatatagctagggcttaacctcgtcgacttgtctgtaaaatcgaatgagacatatatataaacctatgttgttttc

SEQ ID NO: 80193 - DNA, 402 bp, Zea mays
  Clone ID: LIB3088-012-Q1-K1-H9
agttctgaagaaattgctagtatacagaatgcttcatctgtattagagcaatctcagtcgcaaatgatagctgaagatagaagtttgttgctggaaaaagaatataggaataatattctggatgatttactcgaggtaaaatcatttttgactcaacgcttaggggagatgaggaatgcagacacatcatctctacagcatcaagtgcaagctgtctcaccttttgttctccagcagcatgctcctgacagtttggagaacatgcttgtagagatctcgtcagcaatctcattgctaactaatcagaagactcttgaccttataatgatccttaactctaaaggtttctggatagattagtttcaagcttagaagagaagatgcatcacgaagtaaactccg

SEQ ID NO: 80194 - DNA, 437 bp, Zea mays
  Clone ID: LIB3088-013-Q1-K1-A2
gctctactccatcccctcgatctcgaagcgcagcagcagcagtcgggcggccatggacgccagcgcagcaggagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtcggcacgggcgcccccgtctacctggccgccgtcctcgagtacctggccgccgaggtgctggagctggccggcaacgctgccaaggacaacaagaagacccgcatcatcccgcgccacgtgctcctggccatccgcaacgacgaggagctcggcaagctgctgtccggcgtcaccatcgcccacggcggcgtccttcccaacatcaacccggtgc

SEQ ID NO: 80195 - DNA, 448 bp, Zea mays
  Clone ID: LIB3088-013-Q1-K1-A3
acgcccacgcgtccggctggccgcctccaccgcgcctctccgtcactcccccaacgccatgaggctgtaacggcacacgtaccatgggcaggaccagaggcaacaggggcgtgggcggcgcgaagtcgttcccgtcgccggcgtcgtcctcggcctcgtcgtcggagttcgagttcacggtcacgctgtcgccggcgtccaagcagcggtcggcggagcagctgtgcccggccgacgagctcttctacaagggccagctcctgccgctgcagctatcgccgcgcatctccatggtgcgcacgctgctgctgtcctcggcgtccacgtcgtccgcctccgcgtccgactccaccaactccttcttccgcgacttcaacggcagcacgtcgtcgtccttctccgtcgactgcggcgcgctcctgggcccggactcggcggcctcgtcgtc

SEQ ID NO: 80196 - DNA, 424 bp, Zea mays
  Clone ID: LIB3088-013-Q1-K1-A4
gcgccacgcgtccgcccacgcgtccgcggacgcttggggactgggtaacacttaaatgtgcaagccaagctgttattgctgacaacgagactggaaaaaacgggtacactgttccattagaggtcctgccagcatgacaattcgaaccattgtacagaactccactaagcattcaggatggagaattgccagtcctgcccatgtccgtgtatggtgctgttgccatggcacatagtgtggattcagatgaatacaactcaccaactcagttctttttctatctttatgacaagagaaactctggcttaagaggaatatcgttcgacgaggggcaattttcagatttcgggtataccacggattggagagatgttctgtcacagattaagtcctgagataaaattcgatctgccaaacttgtaca

SEQ ID NO: 80197 - DNA, 171 bp, Zea mays
  Clone ID: LIB3088-013-Q1-K1-A6
aacggtggtcctctttgttgcatattatattgcataaaaaaaaaaaaaaaaaaaaaaaaaaaaaagaaaaaaaaaaaaaaaagaaaaaaaaaaaaaaaaaaaaaaaaaaagacaaacaatataaaagaaccaaaaattacgtacacaaaaatgcaaaataataaattattt

SEQ ID NO: 80198 - DNA, 210 bp, Zea mays
  Clone ID: LIB3088-013-Q1-K1-A7
taccggtctgaattccctgtcgactccactcgtacgcccacgctttcttccacacattctaccacttttccgatacaaatgtaatcttgtaaaaatgagaaaaaatttaaaaaataaaaaaaataaaaaaaatataatattaataaaataaaattataaaaaattataataattatatttaattaattttaataataatattatttttat

SEQ ID NO: 80199 - DNA, 421 bp, Zea mays
  Clone ID: LIB3088-012-Q1-K1-G2
ccaacgcgtccgcggacccgtggccccgccgtggctcggccctacccctagcgtgccgccggggtcatctcggagcagcggcagcagcacgtgctccgacagcggctgcggctccggctcccccgtcctgggaaagcactcgagggagtcgaggccgcagggcgacgagaaggcggaacgacggtgcctgtggatccccaagacgctccggatcgacgaccctgtcgaggccgccaagagctcgatctggacgacgctcgggatcgagcctggcgaccggggcatgttcaggccgttccagtcgaagcatggacggcagcaggagctgcaagcgtccggcgccgctcgcgccctgcaggccaacccggcggctctgtcgcgctcgcagtcttttcaggagacgacgtgattactacactac

SEQ ID NO: 80200 - DNA, 454 bp, Zea mays
  Clone ID: LIB3088-013-Q1-K1-A8
ccagctcccgcacgcgccgcaaccccacgttcccacccagcgccattctttggaccttgctggtgcacgcgtgtccgatcgccaaccatggcggccggcgccggcaagtcgaaggaggcggaccccgcgcggtgcaggaggcacccgaagcaccggcacgcggccggggtgtgccctttctgcctacgagaccgcctgtcgcgcctctcggccgccgccgcgtccgcgtccgcgtcgtcctcgtcatcgtccccgtgctcgtcgtgggaggacgccgtagcgcggtcgtcggcccaggcgccgcggccccgccgcggaagcctcgcgctgctgctgcggcaggaagggagggaggcggcgtctgcggcggcggcgctgcccgcgggcagccgagcggagcaggaggagaggaaagccaaaaggggcagcttctgggcgaggcttcaacagcagc

SEQ ID NO: 80201 - DNA, 271 bp, Zea mays
  Clone ID: LIB3088-012-Q1-K1-D8
cggactcgtgggctcgagcggtttttttttttttttttttttttttttttttttttgttgtttttttttttatggtggttgttttttttttttttttgaaaaaaaaaaaaatgctttttattttaaataaaatttagttttttaccaaaaaaccatttttattaagcataaaatttattttatttaaaagctatactctatttattccatatttacaagccaaacctctatgtttctaacttttgcatttaggaaaacatattaaaaattt

SEQ ID NO: 80202 - DNA, 401 bp, Zea mays
  Clone ID: LIB3088-012-Q1-K1-D9
aaaaaaaaaaaaaaaaaaaaaaaaaataattaaaaaaaaaaaaaaaaaaaaaaaaaagaagggaaaaaaaaaaaaaaaagaaaaaaaaaaaaaaaaaaaaaaaaaaaaaaaaaaaaaaaaaaaaaaaaaaaaaaaaaaaaaaaataaaaaaaaaaaaaaaaaaaaaaaaaaatatggcccctctttttaagggtccaattttttttttcccttattttatattttaacttttttttattgtttccctaaaataaattttattgcccattttttaaaacctttttattgtaaaaacccttttttttcccaattataatgttttttgtcaaatatccttttttcctaaatttgttatatttttaaaaattctccctcacctttttccccttttataaaaattt

SEQ ID NO: 80203 - DNA, 441 bp, Zea mays
  Clone ID: LIB3088-012-Q1-K1-E1
ggaggctaccttgcactgcctgcagagaacttcccggctgtcttttcacctgactcggtatttggaaggttcccgtatttcctaccatgcctgtgcacgtcggtcttcgctgctgctgttctagtgagctgcatatggatgccggagactctgcacaggcacaaagttcacgagaatacgagccaggacgttgaaaaggttcaagaaagcggcattaggaagaagaagagcttattcaggaactggccgttgatgtcgtcgataattgtctacggcatcttctcgttccatgacatggcttacacagaggtgttctctctatgggctgaaagtgacaagaagtatggtggactgagcttatcatctgaggacgttggtcaagttcttgcagtcactggtgccagtcttcttggttatcaactctttctataccctagaatc

SEQ ID NO: 80204 - DNA, 379 bp, Zea mays
  Clone ID: LIB3088-012-Q1-K1-E10
accacgcgtccggaaaagagatacacatatgatatggagcttgatgatgccatccgggggcaattttgactgtgaaagaaggatatgaggggcaaatttcctccaacaacattgaaatcggaattattcgagctgaccgtgagttcaaagttctaagcccatcagagatcaaggatttcttggaagaggtggagtaagttgtctgttgatgatttactgtttcaaacaagaatagcagcatcacttatgagcagccagcctgaatcttgtcttggttttataactctgtaaactgatttgctccagcgacatgtctttgtttatatcactcttgtaaactgatttgcttccagcgacattgtggttttaacattttaaa

SEQ ID NO: 80205 - DNA, 348 bp, Zea mays
  Clone ID: LIB3088-012-Q1-K1-E12
cccacgcgtccgaccacgcgtccgcattcttctgtgacatctggttaccaccagagcgtgtgggcaagaataggccgggctgtaaacccgtacatttaccgctatgcgccattcctgaacacacctatttcggcagtccagagatggtggctgaggtaggaaagcatggaccgcagcacagtgaaaatatgcctaaacagctactctgatctcagcgcctcgatcttttagaaggcgtgcttgcacggcgtgttcttttcttgtaaaggttgtattctcagttcatgtcttactgagctactgaaggcataacactagagaatttcttaaaaaaaaaaaaaattatat

SEQ ID NO: 80206 - DNA, 376 bp, Zea mays
  Clone ID: LIB3088-012-Q1-K1-E2
ccaggcccaattcggttttaatggcaaaggctgatggcgcgttggaccctggggaaggaggaaggaggactgaatgaaaaatctgaaaaagaagcagaagcgcgagcatcaccatgatgctggtgctagtcaaattggcatgggtgtaactgcttaccctggtgtttatggggctccacagctcacccagatacctatagcaggaggacaaagggtcatgatgccagagattatcgtaccaaacaacatcttgtttgtccaaaacttgccacacgagacgacgcccatgatgctccagatgctcttctgccagtaccctggcttcaaggaggttcggatgatcgaggcgaagcctgggattgctttcgtggagtat

SEQ ID NO: 80207 - DNA, 415 bp, Zea mays
  Clone ID: LIB3088-012-Q1-K1-E3
aaaaaaaaaaaaaaaaataaaaaaaaaaattttataaaaaaaaaaaaaaaaaaaaaaaaaagaaaaaataaaaaaagaaaaaagaaaaaaaaaaaaaaaaaaaaaaaaaaaaaaaaaaaaaaaaaaaaaaaaaaaaaaaaaaaaaaaaaaaaaaaaaaaaaggggccccctttttaaagatcccaattttatttccccttttttccaacttaaaacttttttattagggcccctaaaattaatttaattgccctctttttaaaaatcttttacttggaaaaaccttgggtttcccaatttaaatcccttttaaaaaaatctccttttctccagtttcttaaataccaaaaagccccttaccatacgctttttaaaaaattttcccaccttaattgtcaaattgaacccccctttt

SEQ ID NO: 80208 - DNA, 299 bp, Zea mays
  unsure at all n locations
  Clone ID: LIB3088-012-Q1-K1-E4
cggcagcccaccggtgtacaagatcgttccgaccttggtcgccgagctgtacagctacagaatcatgccgctaaccaaagaggttcaaatcgcgtatttgcttaggaggctggattgattgtgtttatgtagatgtaaattgccagatcagaactcctggcgttaagccagaacattggtaaataccggttttggtgtcaggatgcaaaatgtaccatgtgtggaattgtgccaacaaacaagcataatatcatgtggagttgtcgcgtagtcgcacctcgtgcgtactgncaatggac

SEQ ID NO: 80209 - DNA, 460 bp, Zea mays
  unsure at all n locations
  Clone ID: LIB3088-012-Q1-K1-E6
cccacgcgttcgcccacgcgtccggacgcgcggaagtacatgcgccacctcccgcagttgccgcgccggccgttcgtcagcctgttcccgcggatgcagcccgtcgcgctggacctcatcgagcggatgctcaccttcaacccgctgcagaggatcacagtggaagaggcgctggagcacccgtacctggaacggctacacgacgtcgccgacgagcccatctgcacggacccgttctcgttcgacttcgagcagcaggctctgacggaagaccaaatgaagcagctgatattcaacgaggccatcgaactcaaccccaacttccgatactagctagctagctagttcggacacacatcttaattatacgtatgtatgattcctcgtacgtgggttggtaaatagaagatcgagccggtcgncggtgttattagactgaacggtgcatttgtttggtccg

SEQ ID NO: 80210 - DNA, 426 bp, Zea mays
  Clone ID: LIB3088-012-Q1-K1-E7
gcgccatccatcgcggcaaaagccgagacgacccaggaatctcggcactgtcgcgtgccgtgcccgtgcgtcgctcccctttctctctcgctcaaaagttgctgctggagccatctcccctctctccgacccccaaccatggatgaggcgcaagttgtggagtcaaaggatggaaccatctcggttgcttctgcatttgctggttatcaggaagctgtgcaagacagggatcacaaattcttgacaaaagcagtggaagaagcatatcgaggagtcgattgcggtgacggaggtccatttggagcagttgtcgtctgtaatgacgaagtagtagtcagctgccataacatggttctgaagcacactgaccctactgcgcatgctgaagtaactgcaattagagaggcttgcaaaaagcttgggaaa

SEQ ID NO: 80211 - DNA, 411 bp, Zea mays
  Clone ID: LIB3088-012-Q1-K1-E8
gctctccatctgctccctgctgaccgaccccaacccggacgaccctcttgtcccggagagtgcccacatgtacaagacggaccggccgaagtacgagtcgacggcccgcagctggacgcagaagtacgcgatgggctgacgaacgctttcctgctcgtctgggcgccattgttcccttggatttgttgttggtcgtatgtatccctgatccatctaggatcatcgtattgtattgtagtgtatgtatgtcgtcggcctaccatcgttgccatccaccatagtgaggtggttggacatgcttcgcctatatgcacctgtgcttgccttccttcgggtcggtgctgtttggttaatgttcatcgaagacgttgatttcgttgcccaaaaaaaaaaaaaaaaaaagggcgggcg

SEQ ID NO: 80212 - DNA, 371 bp, Zea mays
  Clone ID: LIB3088-012-Q1-K1-F10
gaggctctccaggaggcccttcctggtgacaatgttggcttcaatgttaagaatgttgctgtgaaggatctgaagcgtgggtatgtggcctccaactccaaggatgaccctgccaaggaggctgctagcttcacgtcccaggtcatcatcatgaaccaccctgcgcagattggcaacggctatgccccagtgctggactgccacaccttgcacattgctgacaagtttgcggagctcattaccaaaattgataggctgtctggcaaagagcttgagaaggagcccaaattcctcactaatggtgatgctgctatggtgaaaatggttcccactaagcccatggtagtggagaccttttctgaatatccttc

SEQ ID NO: 80213 - DNA, 80 bp, Zea mays
  Clone ID: LIB3088-012-Q1-K1-F11
aaaaaaaaaaaaaaaaaaaaaaaaaaaaaaaaaaaaaaaaaaaaaaaaacaaaaaaaaaggggcgaacgcaatcgggggt

SEQ ID NO: 80214 - DNA, 322 bp, Zea mays
  Clone ID: LIB3088-012-Q1-K1-F6
agaagaggaagaacccgctcacgaacatggctgctgtgctcaagctcaacccctacctcggcactgcccggaagatggccacccttgctgaggctgcccgagtcaaggcccggaaggagaagcttgattccaagaggaccaagcttacctcggagactgccaaggtcaaggctgccggcaaggcgtggtacaagaccatggtctcggacagtgactacaccgagtttgagaacttcaccaagtggctcggagtgacgcaatgaagcggcctttgaagcctagttaagttttgagtagatgtgtcgctgaacttgtattgaga

SEQ ID NO: 80215 - DNA, 450 bp, Zea mays
  Clone ID: LIB3088-012-Q1-K1-F7
caccgcttccgccccggtaccgtcgttcttcgggagatccgcaagtaccagaagagcacggagctgctgatccgcaagctgccgttccagcgcctggtgcgggagatcgcgcaggacttcaagaccgacctacgcttccagagctccgctgtctccgcgctgcaggaggcggctgaggcctaccttgtcggtctcttcgaggacaccaacctctgcgccatccacgccaagcgcgtcaccatcatgcccaaggacatccagcttgcccgccgcatccgtggggagagggcctaagcatcgtatattctgtcatcagtgtccgatcagaagatgtagagatgtgctgggttctgtagtttgggttactgtcgaatcatcgagtagttggttgttcactgctgtaacttaatatcatggatgcatatgaaatggcaatgaactatgttatca

SEQ ID NO: 80216 - DNA, 411 bp, Zea mays
  Clone ID: LIB3088-012-Q1-K1-G10
gccaagggttgtgaggtcattgtgagtggaaagctcagggctcaaagagccaagtccatgaagttcaaggatggctacatgatctcatctggtcagccagtgaatgagtacatcgactcagctgtgagacacgtcctcctcagacagggtgttctgggtatcaaggtgaagatcatgcttgactgggacccgaagggcaaggttggcccgatcacccctcttccggacctggtgaccatccataccccgaaggaggaggacgagctgcgccctcctgtcttggcagctgatgtctaaggtcccaacagcgtcctcgaaatggcagtttgatcttgtcctagctaggggttgtatctatgatacggtcagtgctaagacagttcgttccgtgcacttctgttaaaattagtt

SEQ ID NO: 80217 - DNA, 366 bp, Zea mays
  unsure at all n locations
  Clone ID: LIB3088-012-Q1-K1-G11
cgacgcgattgccaggctgtcctacgtcnacaaacacgagagctgtgggcagtgcacgtgctgccgagagggcacgccctggctctggatgatcatggagaggctcaaggttggtgacgcgaagctagaggaaatcgacatgcttcaggaggtcacgaagcaaatcgaagggcatactatctgtgccctcggggacgctgcggcgtggcctgtgcagggacttatcaggcacttcaggccggagttggagaggaggatccgcgagcgagctgaaagggagctgatggcggcttctgcatgatgtgccagccgcatgtactagttttctgatttctttctaccgaaataatacaaactgatggagct

SEQ ID NO: 80218 - DNA, 343 bp, Zea mays
  Clone ID: LIB3088-012-Q1-K1-D7
cactgttagtgtctcgcgtgcacctttatctcttcatcggtagatgttgtcgaaatagtgtaaatgttactggtgctctgttgtgcttctctaaattcaataatatttgaattggggggggggggggcacgcttgagtacgccaagcttatagtcttgtctgcttgacttgaacgagtgctactgatgctagcatatcaggctgatctgacgcatacaaaagctatccgactatgaatcccaaattgctcatcgcatctcgccaacttatgaaattttacaccacagctatgtgcaaggattttgacatgtagtgctgatgtatgatcctccgtcatttgcag

SEQ ID NO: 80219 - DNA, 185 bp, Zea mays
  Clone ID: LIB3088-012-Q1-K1-B5
cccacgcgtccggtaagctgtagcacggatgtggctcaactgaataacgtgaacgcattgccctttctgttacgtgttttattttattgtgtttctgtggtcgtatatctgttttgtgacgtgtcccttgcttctcccatgtgaattccacaagaactatgagaaatttcaggttggtgatcact

SEQ ID NO: 80220 - DNA, 346 bp, Zea mays
  unsure at all n locations
  Clone ID: LIB3088-012-Q1-K1-B6
ctccccgcgctcggcgaccccagctttgcattccaagaagcgctcgacacctgcttgcgcgtgccagcggggcgcccgccgccgtcggcgaggctcccgcccgtgaccctgctgttcaatggcgcggagatgtcggtggccggggacaggctgctgtacaaggtccccggcgagcgccggggagccgacggcgtgtggtgcctaacgttcgggaacgcggacatggtgcccctgacggcgtacgtgatcgggcaccaccaccagatgaacctgtgggtcgagtacgacctgnagcgcggtcgcctttgggatcggcgcctgtcaagtgcgacgtcgncagcgagcg

SEQ ID NO: 80221 - DNA, 392 bp, Zea mays
  Clone ID: LIB3088-012-Q1-K1-B7
gtcgagcaagattgcagtctgctatgcaaaagaatacttttgcgaggtcatctcagccagtaaggacgacctctgttagtggacagccagtgagaacaactaccattcataggcccaattcaaccgtcaccatcaccaaaccgatgggaaaaagcaggcaaattcagaacagcaggcccaaattctaggaaacggtttgctgcgatatcgcaatttcaactccagagctcatatgtcctctgaagaaagcgcctcctttgtacaaaaggagtagcacaccgtactcatttttttttttggcaaaagagagacgtgccaattgtaacgtaaaaggcgttaccaattgttgtaacaaacgatttctttgattaaaagaaaaagggtttgtttct

SEQ ID NO: 80222 - DNA, 351 bp, Zea mays
  Clone ID: LIB3088-012-Q1-K1-B8
cccacgcgtccgcccacgcgtccgggcagcacctcgaacttctttgggtggttagcacggtttgagaccgtcaaatatttgtgtcgcatatcttgttgtccagaaaattctttcaacttcagaacggagtaaaatattctggtatcaacaacaggacttccgcaataggtagggtttatttcattggcgttcttgaaatattggaccaactggttagaataccaattgggacatgttaatcctggggtttccatttatgcatacaaaggaccaaaatcttgtgtcaatggaaatttgcagctttttttaaaaaaaaaatttttatctttaaaagcgttttcaatttttttt

SEQ ID NO: 80223 - DNA, 209 bp, Zea mays
  Clone ID: LIB3088-012-Q1-K1-B9
gtgaataaatggagaagaacaaagttaaaggagaacatcaggttgcttgcattaggccatcattgtacctctttccatctggctctcgtgttgccttggttgaatttgtgcttaatgtagccatgaatttggtggcccacatatggacgcatgtgttgttgttggccctctcccttagaagtgattaaaagttgcttttggaccacatg

SEQ ID NO: 80224 - DNA, 304 bp, Zea mays
  Clone ID: LIB3088-012-Q1-K1-C1
aaaaaaaaaaaaaaataaatataaaaagttttattttaaaaaaaaaaaaaaaataaaaaatgaatggattatttaaagggcggccggctttataaatatccaaagcttaacttacacaatcatccgccttcttatctattccatcctacctccctaaatcattcacactaactcccttttttacaactttctccactctaaaatccattgccttacccattttaatcaccttccatcaaaaccccttttctccaccatccctaattacctaacagcccttcccccattgcccttcctaatattt

SEQ ID NO: 80225 - DNA, 81 bp, Zea mays
  Clone ID: LIB3088-012-Q1-K1-C10
aaaaaaaaaaaaaaaaaaaaaaaaaaaatttaaaaaaaaaaaaaaaaaaaaaaaaaaaagggaaagggcttccattggggg

SEQ ID NO: 80226 - DNA, 277 bp, Zea mays
  Clone ID: LIB3088-012-Q1-K1-C2
cggacgcgtgggtccgaggcacgcgaggacctggccgccctggagaaggactacgaggaggtggccgcagagggcggcagtgatgacggcgacgaggaggaggaatactgatctgcttgcatgaatctgtttggctgtcgagccaggttgtggtgttgaaaaacctttgtttgtgtcctgggtaatgtttgggtgtttccttccatcatcacttgctgaactgctctagtatttgcatttgtaattgaagtctgtcgctttaagcactcttggttct

SEQ ID NO: 80227 - DNA, 408 bp, Zea mays
  Clone ID: LIB3088-012-Q1-K1-C3
ccctaatcgccgtccgccggcgacgccagcacgatggcccgctacgaccgcgccatcaccgttttctcccccgacggccacctcttccaggtggagtacgctctcgaggccgtccgcaagggcaacgccgccgtgggcgtccgcggcacggacaccgtcgtcctcggcgtcgagaagaagtccacacccaagctccaggactccaggtccgtgcgcaagatcgcgtgcctagacactcacatagctctggcgtgcgcggggctgaaggcggacgcgcgcgtgctcatcaaccgcgcgcgggtcgagtgccagagccaccgactcaccgtcgaggaccccgtcaccgtcgagtacatcacccgctacatcgctgggctgcagcagaagtatacgcaaagtggtggagtc

SEQ ID NO: 80228 - DNA, 249 bp, Zea mays
  Clone ID: LIB3088-012-Q1-K1-C4
cagaacgacatcgaccttctcaacccgccggcagagctcgagaagctcaagcacaagaggaagcgcctcgtccagtcccccaactccttcttcatggatgtcaagtgccagggatgcttcagcataaccacggttttcagccactcccagactgttgttgtgtgcccaggctgccaaactgttctctgccagcccacgggaggaaaggcgaagctcacggaaggatgctcttttcgccggaagggagac

SEQ ID NO: 80229 - DNA, 308 bp, Zea mays
  Clone ID: LIB3088-012-Q1-K1-C5
gcttccgccaacgcttccgcgataggagattttccttcctttcgtcgtcaaagcagatcgtcagcggcgggaacgatgaggaaaaggttattgtctttgaacgtggagatttagtttttgttttcaatttccatcccaagaaaacttacgagggctacaaagtgggatgcgatttgcctgggaaatacagagtagccctggactctgatgctctggtcttcggtggacatggaagagttggccacgacgtggatcacttcacgtcgcctgaaggggtgccaggggtgcccgaaacgaactttaacaac

SEQ ID NO: 80230 - DNA, 440 bp, Zea mays
  Clone ID: LIB3088-012-Q1-K1-C7
ggccgcccttttttttttttttttttttcaacataatgatttttttatgattcatggtgggaaatcattattaacacgagatcacagcgttcctgcactggcaatgtaacagaataaactggcactggcaatgtacagaataaactggcaacgtagaccctgtcaacgaaatttttagccactagggtagcagcctatgccctctgaaccaaaaggtaaattgatttgcaattgccaaactagcagctgcccaatggccccgataaatgtttatcaacatgagacgacaaagtttcggcactggcaatgtttaacaggaaaactaggtcaaaataaccccacttcaaaaaagttgcagttcgcgacttctgccccagcccgaaatccgtaaaagagcactgctcatcttgtaccagtgaaaaaaataagcttcagattga

SEQ ID NO: 80231 - DNA, 420 bp, Zea mays
  Clone ID: LIB3088-012-Q1-K1-C8
cggacgcgtgggcgcgcatcggcgagggctgatgcagcgccgaggagtgcgagcggatggtcgccggcgtcgacgccgacggctgcgtcgggttcgaggacttcaagaagatgatgtgcccccagccgcaagccgaagccggcgccgccgggcgggacaaggcagaggccgaggccgaggacaaggaggagtgacgggtgtagtcaggggggaacgggaacggctggagttgtttgcgtctcgcgttcttttcacctgtacgcaggaaatactcctcctgcataagactactgtacttttggataaaaaattttatttctacatgactatcacgtagatgtaaaaaaaaaaagttgcaattcgcgacttttgccccagcctcaaattcctaaaatagcactgtttattttggtacctatg

SEQ ID NO: 80232 - DNA, 449 bp, Zea mays
  unsure at all n locations
  Clone ID: LIB3088-012-Q1-K1-D1
gtttacgtgaaaatattggtgctttggtgcatgcacttttactggctaagccagtgggcgtgaagaaaacttcgaggatgtcggatatgtgaagaagttcacactgagtagcacaatgggacccggacttnctgttaccataccatcactatctgtggccgccgatcactataacaaggttcaagtcagctaagtcaatacagtagaacatcgaatgtagctttctttctccaatagccgcggcctgcagatggcggcttgtttggcagtggagcttaaccattcagcaaggttgagatttgggtggcttgctgttttgttattggggataataccttttgtggacaaggatcattcaacaaacatcataacctataactttattttatccttgtcactgcaattttgagattgcgtngcttgtctacctatgttatccagagtcttgt

SEQ ID NO: 80233 - DNA, 66 bp, Zea mays
  Clone ID: LIB3088-012-Q1-K1-D10
gacgcgtgggcagacgcgtgggaaaaaattaaaaaaaaaaaaaaaaaaaaaaaaaaggaaggaatt

SEQ ID NO: 80234 - DNA, 412 bp, Zea mays
  unsure at all n locations
  Clone ID: LIB3088-012-Q1-K1-D2
cggacccgtggccggacccgtgggggcctctgtccggggggagatggagcctctgaccgaaggaaggcaacgccggaactggagcaagccgtcgcacgccgagaggaccaatatgccgttgccggacatccggcgcagtgtctccctgccgcgcgggaagaaccctcttgtgtgaatctagctcgtttcgccaaccaggcattctttcattggttgtttgtttctttatcctgtggttcgatccgaatgtaggctctacggctgtgtagaacacgtcatccggatgcataacacaaagtctgtcgagttgcttccaccaggctcccatgaaaacgcaaagttcacgctcttatgcgcgatgtaaaaaaaaaaaatnaaaataaaataaattataataaaaaaaaaagggcgg

SEQ ID NO: 80235 - DNA, 214 bp, Zea mays
  Clone ID: LIB3088-012-Q1-K1-D3
cccacgcgtccgcccacgcgtccggttgttttcttgttttatcgactaattgggtgactgccgaagagttggtttgtagtcaatgaggtatgctgccccctgtggtgctacgcagctgcagcaacataagatggtcaggctaaaatcatgttgtgggatctgattctaatgatgcttatttagtactattacaaatatctatcgttgcttatat

SEQ ID NO: 80236 - DNA, 383 bp, Zea mays
  Clone ID: LIB3088-012-Q1-K1-D5
cggacgcgtggggccgcgcggggtgtgaaatacgtagattgctacggagttgacaacgcgctggttcgagttgcagatccgacgttcttagggtacttcattgacaagggcgcatcttctgccgccaaagtggttaggaaggcttatccgcaagagaatgttggggtgttcgttcaacgaggccgtggtggaccgctctcggtggttgagtacagcgaaatggatgcggctatggctaccgaaatgaatcagtcgacagggcgacttcgttactgttggagcaacatctgcctgcacatgttcactctggacttcttgaaccaagtggcaaacagccttgagaaggacagtgtataccatctagctgagaagaagatcccttc

SEQ ID NO: 80237 - DNA, 131 bp, Zea mays
  Clone ID: LIB3088-012-Q1-K1-B4
cccacgcgtccggcgggtgctgtgcgtggagagtgttccacgcggctgacgtttctagtagtgtagtggacctgtgaccatggtggattctttcatctgttcaatgaaaaaaaaaacaaatattttcacgc

SEQ ID NO: 80238 - DNA, 349 bp, Zea mays
  Clone ID: LIB3088-012-Q1-K1-D6
gtcagattttggattgtgtaagccaattgattgttcgaagttgtcaacactgaatgaagatgaaccaatgactgatgaaaaccttagggagtctatggacatcgatcattctctctctgatactgcaaatggtaggaggcggagaagtccaaatgaacagcttcagcatggacagaacaacatgagaaaactgacattttcaacactcacgacacctgattatatcgctccataggttatacttaagacaggatatcgactagagtgagactggtggacattaggtgcaatcatgtatgaaatgcttgctggttatccaccattgtattcagatgatccactagttaca

SEQ ID NO: 80239 - DNA, 325 bp, Zea mays
  Clone ID: LIB3088-029-Q1-K1-E12
cacatccccaattccccaggtacttgctcgtaatttttccactgccatcgcacgctttcagtaaaccctaaaccggggaccggggtttatcggtgaggcgagccgccagtggaactgttgaagcgtctatcttttctcttctttgtcttgctgcgcacgaagattgtaaacgagaggagggcggcaatcgcgaagaggctgatcccgtcgctgaaccgggtgctggtggttaagctggttcagcccaagaagacctgcctcggcatcctcctccctgaaacatccaagcacctcaatgctgctaaagtggttgctgttggccctg

SEQ ID NO: 80240 - DNA, 264 bp, Zea mays
  Clone ID: LIB3088-029-Q1-K1-E2
acgacgcctcccacgactcctccgaccactcctgcctacaaaagtactccggaagatgcggtcagctgtacagctgataagcgacatcgccaaggcttgcaatgcgaactaaactgaattataatgccccttcatggagcgcctctgctggcatggtcttcaataatcatgcttcactcacgccaagcacatctacatctcggacatgatgaaccatgatatccagaaggcgacactcatcgtgctgggagcggtagaactgct

SEQ ID NO: 80241 - DNA, 449 bp, Zea mays
  Clone ID: LIB3088-029-Q1-K1-E4
gagaaggaatccgatccatccaagccaagccaaggcagagaagaagaagaagaggaggaggaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctggatgtagttgcttgaatttaatcctgttttgctaccgtacccaccccatgcatcatctggcaacgcgacgcaattatcattgttattacaagttcacagattgattcattcgctgctttt

SEQ ID NO: 80242 - DNA, 318 bp, Zea mays
  Clone ID: LIB3088-029-Q1-K1-E5
agctcgtatgcgagcgatgctacgtgcactcgtctcctcttattgcagtagggcaataggagtacagttaggtgtgttgccgtggttgtagttgccgatgtgtttgttttatgggctgggctcggttgatgtgttctatgtaagaaagtaactgtattgtttatgcagataccttaccatgcatgctttaagtagcatatcataatctataatgaatatgttttatgtatattactataataaatctcttttttttttttacttattatatttttttatttattttcttattatatattattcttttatatctatatt

SEQ ID NO: 80243 - DNA, 422 bp, Zea mays
  Clone ID: LIB3088-029-Q1-K1-E7
cccacgcgtacgaccacgcgtccgtgacaagattacgctggagacagcaaaggttttgagagaagattatttggcacaaaatgcattcaccccatatgataagttctgcccattctacaaatctgtttggatgatgcgcaacattattcacttcaacacattggcaaatcaggctttggagcgggcagctggtactgacggccataagataacatacagtgtcataaagtatcggatgggggatctattttatcgcctagtatcccaaaagtttgaggatcctgcataaggcgaagaagctttgggcgtcaagtttaagaaactgtttgacgaccttaccactgggtttctctacctaatagatgatgcacggtgaactgctgtagattttgtgtatgacaataatggctgtcaaatgtttt

SEQ ID NO: 80244 - DNA, 266 bp, Zea mays
  Clone ID: LIB3088-029-Q1-K1-E8
cccacgcgtccgcccacgcgtccgaccactcaaccagtgcgctactccaagtgcttgtggacgctctgcgtcttcgatgcggataaggcaaacaagttgaagcaatctcttacaccatgtttgaccgtcgaggaggtctgattggatacatggcaacatcaggttgaactaccaaagcttctttatcagtagcagagtatgctactctatgtacttttggaacctaagctattatacctgtcagtgttggatgtgtggatcttgca

SEQ ID NO: 80245 - DNA, 447 bp, Zea mays
  Clone ID: LIB3088-029-Q1-K1-E9
ttcccgaattgacggacggacgcactcgttctgatacagcacgcctaaacatactcacatagtctgttacctatcccgaacgatcggagcttagtgaaccaaccatccgggagtgggatgccaaaaagacacaagctcaaaatgatccacctgatcaccagagaaattgcgaaactctctagcctatcactcatatccatcatcataggagccgctacatatatgatcttcactacacaaggaatcagatatcacaccatctttaccagtttagcgctcgaccagagctatgcagatcatcacctgatctcaaagtgaaaaaagccaggatactagcacatacgctggctcaggtgcatacagacacctgaccacaactttgcaacgacttgtacctgcctagtccccaagcatttgatggatgatcaagatattcaatgtgtccat

SEQ ID NO: 80246 - DNA, 70 bp, Zea mays
  Clone ID: LIB3088-029-Q1-K1-F10
aaaaaacaaaataaaaaaaaaaaattaaaataaaaaataaaataataaaaaaaaaagaaaaaagaaaaaa

SEQ ID NO: 80247 - DNA, 128 bp, Zea mays
  Clone ID: LIB3088-029-Q1-K1-F11
agcccacgcgtcccagcatggactgcgcatcgatgggtgctggtacccccgtcaggctctatgctaagcggaatcctaaggaaaacaatggggcttcctggtgctgcaaaacaaacaataactaacac

SEQ ID NO: 80248 - DNA, 409 bp, Zea mays
  Clone ID: LIB3088-029-Q1-K1-F12
acgcccacgcgttctgcgggaaggctctggtcaacggcggcgccaatcgccaccggggggcggggcgtgacaacatggaggggcatgaccaagccggcgatccgcaggttggcgaggaggggccgtgtcaagcgcatctccgggctcatgtacgaggagacccgcggattgctcaagatcttcctcgagaacgtcatccgcgacgccgtcacctacaccgagcacgcccgtcgcaagactgtgaccgccatggacgttgtctactctctcaagcgccagggccgcaccctctacggtttcggcagataggtcgcccctctcccggtggcgaattacttggtgcctgtggaggacgtgttgagttcctggactagttagtctgtgttgcctttatcggggctgttttctg

SEQ ID NO: 80249 - DNA, 245 bp, Zea mays
  Clone ID: LIB3088-029-Q1-K1-F3
gccacgcgtcctgctactcgtacgtgcactcgtccgttcacgcgtgcgcaaggtgttcggggcctgtctacgtgctacctggggccgcaacattggcctgatgctgctgccatgtagcccagcgctaccccctcggcttcaccgtccgcggcggcaacgactgtgtaaactacatcgggtgctagctcctactgtggtgcgtgctttgatgactatagggcatgctttgcgctggcatctttgtt

SEQ ID NO: 80250 - DNA, 344 bp, Zea mays
  Clone ID: LIB3088-029-Q1-K1-F4
atgaaattattattaaaaaaaaaaaaaaattaaaataaaaaaaaataaaaatatattaaaggattaatattaaaaattttaaaatataaaaaaaaaatatatatattttttttatttttaataatattttataatatttttaattttttattattaattatttttaattttttatatataaattttttttattttatttttttttttattttaatttttttttatttatttttattatttttattttttttttttttattttttttactttatattattttatatttttttatatatattattttttttatatttttattatttttttatttaatttttatttt

SEQ ID NO: 80251 - DNA, 424 bp, Zea mays
  Clone ID: LIB3088-029-Q1-K1-F5
cttggtattcaacacctacctatggtggatgactggacaaaagatgaagatggtgcggaactccttcgaagatgaaagcaaggatatcatagagatggaaacggaggaagcctatgagatggtacttaatgctgtgctgaaatgggtggagagcaacatgaaccccaggacatcaagaacattctttgtcactatgtcacccacccacacaaggagcagagactggggcgatgatactgacgggaactgctacaaccagacagcccccatcgaggacctgtcctactgggggccagacaccagcaagggcctgatgcgcgtgatcggagaagtgttcagcgcgtttaagatcatgatccccgtgggggttgggaacattatccaactcttcgagtacaggaaggacgcgcacacccagatttac

SEQ ID NO: 80252 - DNA, 243 bp, Zea mays
  Clone ID: LIB3088-029-Q1-K1-F6
cccacgcgtccggcccaagctcccatcagccaaggactggtgtagtggtggggagtgtggacaattgtgtgtaagtgtaactgtgtctgactctatatgatgttggcatgtgcatgttgctatccaccgatcttgatggcttacttagacttgagaatacttttaggttgcaatttcaaactgcactattattctgtaaactgtgagttaagtattacatgtactgttaaactcaataaataa

SEQ ID NO: 80253 - DNA, 303 bp, Zea mays
  Clone ID: LIB3088-029-Q1-K1-F7
tgctaacttaatttaatctgttgattaattcgcctttctttgtttttgcaggggaacatggtcttattccattggcatctggtgggtggcaagaaactaatcaaggagtctctctcttctcattctctgcgtggaggactgtttagctgtagctgagtggcatgctttccagaacataaattggcggaagagaatttcgatgctaccactttgcgagaaggaccgaaccaactcaataacatcaaacttagatactgcagcttaccaactttgtcaatattgaagattgaagagcatctagat

SEQ ID NO: 80254 - DNA, 297 bp, Zea mays
  Clone ID: LIB3088-029-Q1-K1-F8
gaacgatcgaccaacaatggagtggcccactagattaaagatcgctctgggtgctgccgggggtttagcttatctgcatgaagactgccatccaaagatcatccaccgcgacattaaggcatctaacattcttcttgacttcaaatttgaagctatggctgctgactttggacttgcaaagttcactactgataacaacacccatgtgtcaacaagagtaatgggcacctttgggtatttggcacctgtatatgcatcatttggcaagctcacagaaatattcgttgtattttcttt

SEQ ID NO: 80255 - DNA, 432 bp, Zea mays
  Clone ID: LIB3088-029-Q1-K1-E11
ttcccggatcgacggatggatgcaagcaaactcatatccctaagaccattatatcattaagccagtccattctcttaccacaggtttcgggggaacccaaatgcgggtcacaacacttaagactacaatacctgcccggcaagtactctccgggcacgttcagcacactcaagctgaatatcccacccagcctaatggatgccaaccgcaatatcaatctacactccatgcgctacatatctcgatcgctactaccctgatggctagcagtaaccaggtgcaaaagctctgagaatatcagctgaggatacttcacctttacaagcctcttgatctagaatcatacaatatgcattcttcattggtcttcttaccaacatttcttgaatcatttatgagcaatacacaagaatgctttagaagtattattac

SEQ ID NO: 80256 - DNA, 450 bp, Zea mays
  Clone ID: LIB3088-029-Q1-K1-F9
ccagccggtcggacaacggctgctgcggcggcagcgccatacgcgtacaggcggctgcgggtgaacccaaatgcggatcacgagcctgaagactacagcgacgtgcgcggtgagtacgcgcacaggcgcgtacagcgcactcgagcggcatctaccacccagtctcatcgatgccgaccgcgatgtcaagctacacttcatgcggcacattctcgcgcgctactggccgaaaggcgagcgtaacaaggtgcaaaagcacagagaatataggcagaagatactccacctttacaagcctcttcatgaagaattatacaatatgcatccttcagtgttcttcttaccaacattccttgaagcagttaggagcaatacagaataatgctttagaagtattatgactgagccaatttctggggtttattcgtttgctatgttgcaacctacttt

SEQ ID NO: 80257 - DNA, 437 bp, Zea mays
  Clone ID: LIB3088-029-Q1-K1-C11
gcgatcacaagcaaaatcaacacggtcgcagcacaagcaagaaccacacctactcggtcaccggtgatcatgttgtcgggctgcggcagcaagtgcgagtgcggctccagctgctcctgcatcagcgtatgcaacggctgcggtatgtacactgacgtgtacaccaccgtcaccagcagcgtcaagaccacggtcctcgacgctccgaccaccaaggtcagcgccggcagcttcgacgcggtcaccgacggcgacagctgcgactgcaacacctgcaagtgcaggaccagctgcggctgcttctagtgcagctgcaactgaaccggcccggttcggcgatagctcacgagagtcgagaggacgacgaccaggaggcgtataatacatataatagcggtctacagttaataagatcctgtcaactgcacccgccatta

SEQ ID NO: 80258 - DNA, 346 bp, Zea mays
  Clone ID: LIB3088-029-Q1-K1-C12
tacacgcgccaatgatgcaatgatagatcatgaggctcacaaatgcacaacccaggttctgggtacatagatcaacgtgacggctgacgcatgtgtctactgagagggctatgactgaacattatatacagaaatccacgagtatgaagcagatgaatgatgcattctgattaacttacaaacatactacctcaatactatagaaggctcttattagaaaaatccatataattctggtgaatcatactattatacaaactagtagactattaactatgtctcaccaaattactctgaactaagattagaccgtaactcatatgatccaataattgtctatggcgct

SEQ ID NO: 80259 - DNA, 327 bp, Zea mays
  Clone ID: LIB3088-029-Q1-K1-C2
cagactcgtgggcggactcgtgggccgacacgtgggcactgcaccggtgccatatgccgggcaagatgcacaagatggccggcatctcggatgcagacattgatctcgacgttcttctctaatactacgacgacaagtcttactataattctaaatccatgatcaacaagtctcgcacttgtcacgcactactaggagatttctgcacgcataagatcaacgagggacacgacatctatacgctactggaaagcgagccgggcaactactacatcctattacaagacgaacacattatctagatctaagaaatttgttcctggttac

SEQ ID NO: 80260 - DNA, 318 bp, Zea mays
  Clone ID: LIB3088-029-Q1-K1-C3
cccacgcgttcgcggacgcgtgggggttgttcacttggtattttgtagattaatctggggaagctttggtctatgttgtgcatgtgtaagaaaatgtatttgtatggattgaagttcgtggcgaaagaaaaagaagtagaaaaggactcgaacgtttttatatttcgataggaatatatgcgatgtattgtttgatgtgtgcgatttgtagtttgtataattatattttggttgatgtggtgttaaaaaaaaattttatttttttttttattttttaaattttataataaagggttgcctttttttaggatccaatct

SEQ ID NO: 80261 - DNA, 316 bp, Zea mays
  Clone ID: LIB3088-029-Q1-K1-C5
tccacgcgtccgcccacgcgtccgtcaggacaagatgatctgccgcaagtgctatgcacggctgcaccccagggctgttaactgccgcaagaagaagtgtggccacagcaaccagctgagggcaaagaagaagatcaagaactgaagcttgccaaatcggttccttgcatggtttgcgtcaacaagacgaagtttcaaagcttttgttgctgcatatgctgctgcaaccgtttgcactcgtaactcgtgtgttcctgttcagggtcttcagcatgacataaatcgtttcagaaggtctagcatattattactaata

SEQ ID NO: 80262 - DNA, 330 bp, Zea mays
  Clone ID: LIB3088-029-Q1-K1-C7
aacagggcacacctccattaaatcctcaacaatacatggaaacaatgcaaagggtcatggaaaacccccagtttatgaccatggcagagcgtctggggaatgctcttatgcaggatcctgctatgtccagtatgctggaaacctttagtagtccatcacataaggagcagctggaagagcgtatgtcttgcattaaggaagatccagctatgaagtcaattcttgatgagttagagaatggtggcccttctgcaattatgaattactggaacgaccctgatacttcttaaaagattgtgtaggcattggtagcttgcttgtcattttgtg

SEQ ID NO: 80263 - DNA, 148 bp, Zea mays
  Clone ID: LIB3088-029-Q1-K1-C8
tgccacgcgtacattgttaagggacctaatttccttatcaagtacctacctggacaattgggagcatttgaaatgggaccgggacaatcacgcattactccaatggcccaagtcacaaaggcaattctcgagaacccaaatgacaaca

SEQ ID NO: 80264 - DNA, 461 bp, Zea mays
  Clone ID: LIB3088-029-Q1-K1-D1
accgtccgaaatccccggtcggacccacgcctaccggccacttaccaacacctgggtgctcatgccctggaacttcccaacaatgctattcgtggggtgcaaggtgctggcaatctgcatgctgcaccactgctattcaacgtattcactgccaatgagcacaaaacgccgtggcgcacgtattgcttgaaggaagatgaaccaaggcgcattcaaaaaggtgcttgagaagcttgcttgtgaaaggtacaactcttgttaatccaattgacttgaaacattttgggctaaacatggcacaaataaagtttgttaacgatcaaggtaattgagaaaaggctttgctattgttttgccactttgtaggttgttattcttcaattaggcctgatttattggctgtatgtctatgtgcccatcttcagacatttgtaggaattagtttgttctcttgtttaagt

SEQ ID NO: 80265 - DNA, 263 bp, Zea mays
  Clone ID: LIB3088-029-Q1-K1-D11
gcacccatgcgtacacaggatttcaccgattcctgctgcaaatgaagttgaaagctaaacttagtgatatgcgcacaagacattggtgtgtaggattccgattaatgtaaatcaattgtcacaccaattgctgatctatgaacatttaagttgtctatatcattagctaaacttcagctgctaaggtcctacgcataaataatcttgacttcccaaagcatgagatcagacggaaggtgtattatgttcacctttatcaacac

SEQ ID NO: 80266 - DNA, 407 bp, Zea mays
  unsure at all n locations
  Clone ID: LIB3088-029-Q1-K1-D3
gtcctgtggggtgatccgcgtgagaagctctgtcaagttatccatgataccccgctgaggtgcttggttataggaagcaggggccttggcaagctcaagagggtgctcttgggaagtgtcagcgactatgttgtgaacaatgcaacctgccctgtcaccgtcgtcaagtcaacaagcaccgaaggttgatcttatcgccgagatgcctggatgtgatgttgtaataaagatggttggcctgatgaagaacatgcactagtttctagctatttgaaacatgttgaacgaggcaattctaatgtaataataatagacaaagtgccttatgaaggacatggttgacatgcctttgntgctgtatgagtgatgtttatagttttgagggtttgaagatgtggatcatttgc

SEQ ID NO: 80267 - DNA, 90 bp, Zea mays
  Clone ID: LIB3088-029-Q1-K1-D4
aaaaaaaaaaaatataaaaaaaaaaaaaatttaaaaaatataaattaacaaaaaacaaaagagagatacataaaaatttactcttgaaat

SEQ ID NO: 80268 - DNA, 339 bp, Zea mays
  Clone ID: LIB3088-029-Q1-K1-D6
gcggctgctgctgtgtggacatctgtccgacggtctggggcgctcatggtcaacatcggagggcttttggagctagggaccaatgaccggttcaggagcgtggagcacccgtggccagccaacatgagcagggacacggacagggtctacgaggcggtcttcttcaacactgacgttaggaggtccgagaggatgtacggacccattccagaccccagcaagcccccgatgtacaggagcgtcatggaccgagacttcatcgtatagttcaacaccattggactcgatggccgttcgcttgaccactttaagctctagctggctggctgggtacgtttc

SEQ ID NO: 80269 - DNA, 154 bp, Zea mays
  Clone ID: LIB3088-029-Q1-K1-D7
tccacgcgtccgtccacgcgtccttccactcgttcttcaactcgttcttcggggcttgcggataaatgctaggcgagaaacattcttgtgtgtagttaatacgtcactctgatgtttttgttgttgttgacataatagcagtgcatgttgttct

SEQ ID NO: 80270 - DNA, 439 bp, Zea mays
  Clone ID: LIB3088-029-Q1-K1-D8
cccacgcgtccgatcaacgcgtccatcactaactccaacaccgccatcgagataagggagttcctctgcgagaagaaggtcagaaaggtggacatgcttgactgcgtgaccatcctccgctccgagaaggtcaaggacgagcttattctcgatggcaacgacgtcgagttagtctctcgctccgtcgtcctcatcaaccagaaatgccatgtcaagaagaaggatatcatgaagtttttggatggtatctatgtgagcgacaagggtgtgatcgaataggttcagtgtgggtcaatttgtgttatcttttgagttggtattattgtttgttttgctatttctctaggtttctttgttatcttttgtatgtttttttgtccttttttttttcctctattttatcttttttttttttttttaatttttattcttttttttt

SEQ ID NO: 80271 - DNA, 333 bp, Zea mays
  Clone ID: LIB3088-029-Q1-K1-C10
cacactcagaaatgctcccttcttagagcatgatgttcccaaatccacaacaaggtttcaggcgcaagacctgaaggggcccgctaaatcatgcctagactgacaagtctctagcggagccccatccacggagatcttcagaaatgaatcggacgataaatgcactattattcactcacagccattctgcattgggacttttgatggtacttattagaaagatctgctgccttctgtagtatctatattccataacaactgcgagaccaaatctttccgatgcccatggtatgctagctaaaattagactctaacttatccgatccactaatc

SEQ ID NO: 80272 - DNA, 444 bp, Zea mays
  Clone ID: LIB3088-029-Q1-K1-D9
atcacaagcaaaagcaacaaggcagcagcacaagcaagaaccacacctactcccttcgccggtgatcatgtcgtcttgctgcggccgcaagtgcgggtgcggctccagctgctcctgcggcagcggatgcaacggctgcggtatgtaccctgacgtggagaccgccgccaccagcagcgtcaagaccacggtcctcgccgcgccgaccaccaaggccagcgccggcggcttcgacgcggtcaccgagggcggcggctgcgactgcaacacctgcaagtgcagcaccagctgcggctgctcctgctgcagctgcaactgagccggcccggctcggcgatggcgcacgagagtcgagaggacgactactaggaggcgtataataaatataatagcggcgtccaataaataagatcctgtcaactgcacccgccattatccatggtc

SEQ ID NO: 80273 - DNA, 130 bp, Zea mays
  Clone ID: LIB3088-029-Q1-K1-E1
atctgccctgagtggctcctatcgtgttatgtttctgtcggttcttatctatctgtcggggtgtggtttacaacttacgttgtaagactttattcccccgctttgctactgggttattaagtttggcgtt

SEQ ID NO: 80274 - DNA, 320 bp, Zea mays
  unsure at all n locations
  Clone ID: LIB3088-027-Q1-K1-H3
actgtggagtgagttgggagcttgacaccccgggatgagagggcactgcttcggatgcagcgtgtagcctcggatccttgtaaattttcaggtcttggtcaggagtttgttagtgagactgctttgcttcttcttcttcttcttattttctctcgatccatacggtttgcacatggaattatatcagtaacaaattagagtagcttactattagatttacagccagacatgtcatgtacttgctgctactctcttgcagatgggaatcgagcgtgtagccttttgagagtnaanaaaaatataaaaataaaattaaatat

SEQ ID NO: 80275 - DNA, 427 bp, Zea mays
  Clone ID: LIB3088-029-Q1-K1-A1
cggacagctggggctttggctactgcaactgcgtgttgacaattgagggttaaaaacaggactataaatggcccgatgcgtatatctgcaggtggcatgaccagcgatggctgtcgaaccttgaattaatagcacatgatgtagattagagtcagcgtggctagagaatggggattccaacgcacgtcaggtgctaatgctgttcgtgatgtcaacatgatcatatgtgatgaactgctgatctatatacactgagatacatgtactgaatgccaacatggagcaccaaatgtgtgataatcacctgctaatatagctgtctgatgaacagatggatgtgattactgatatgctctcatgtactgatactgctactgtccggaaactatgggctgacgttctagaaggcccaggcatacttacgcgt

SEQ ID NO: 80276 - DNA, 362 bp, Zea mays
  Clone ID: LIB3088-029-Q1-K1-A11
cggacgcgtgggcgcgccgccgccgtcgccgaaacagcacatcgctctctcgatctcaggggtggcggacgtggagcagcccgaggacgcggtgaagctcttcaaccgctggaccttcgacgatgtccaggtgaacgatatctcgctgaacgactacctggctgtgactgcggcgaagcacgcgacattcctgccggactccgcggggcgctactccaagaagcggttccgcaaggcgcagtgcgccatcgtcgagcgcctcaccaactcgctcatgatgcacgggcgcaacaactgcaagaaggtcatggccgttcgcatcatgaagcacaccctggagatcatccaactgctcactgacg

SEQ ID NO: 80277 - DNA, 411 bp, Zea mays
  Clone ID: LIB3088-029-Q1-K1-A2
cggtactgacccagctcgtacccacgcctcctgccactcttgctcgcacagcgtgcgccactcgtccgctcccatgcgttgggttcgactgcacaccttctggggtggagttcggagatgttagctcatacgttcccgcaagctcaactttcatgaagggcagttgtcgtgaacgctacattctactcggcttgcccgatgaatgaccttgtcactgacggcacgttcgctctcgttgagaagctggactgcttcaacagctgggttcctgcctacgactactacgactggtcactacgcttcaagtggtcgagaccgtctaagctgatcccgagaagcttcactacgcttgaatggaccattcctgtagactccccctcttgcgtttataggtttaagcattttggtgcc

SEQ ID NO: 80278 - DNA, 442 bp, Zea mays
  Clone ID: LIB3088-029-Q1-K1-A3
atgaaattggaccgatcgtagctaatagcaacggtggagttaaccatagtagaaatgaagggactgagaatttgtcctcagaaaaggaagcagctgacgatcattcatcggtaagcaaacctgtgttaccggatgcccacaaattaacagaccaagagaatggaaatgatgcagtatagagagtggatgttagcgtagctagtcgttctgttgcatctgacgcgttcactgaaaatcagtggctcagacgtgtctgcttcatcgacgcgcgtatagctgtgaggcatagtgagcaatagtttcacgaacatctatcaagaatcacacgaagatgcagcatgaggcaaatttgtttcaaactataaaccacgatctagggttaagcccttttttctttttccccacgaattttttgatgtactgtaggttatgtgatgcatat

SEQ ID NO: 80279 - DNA, 204 bp, Zea mays
  Clone ID: LIB3088-029-Q1-K1-A4
agctcgcctgctgcagagtctaaactccaaacgatctgtactaacttatcgataatgaggagcttatgctgtagaacctcgactagatctatcgacatcgaacccagctggagaaaaacctatgacgaatatgctccatcatgattaccgtagcttgaatctcggactcagcatctaacgcagcactgttgaaagcacattagt

SEQ ID NO: 80280 - DNA, 388 bp, Zea mays
  Clone ID: LIB3088-029-Q1-K1-A7
cccacgcgtccgtgatgctgtcaatgggtttccagatgacggttggtcactgatgagcggtgacggtgctgaggatgttactattgctatcaactcttctccaaacaaacttattggtcctcatgtcaactcttcccagctgtttactgcgatcggaggtggcatcctgtgtgctaaggcatcaatgctgcttcagaatgtgccacctgccctactagtacgatttctgagggagcatcgctccgaatgggctgatcctggtgttgatgcttattctgccgctgctctgagggctagtccatatgcagttcctggcttgcgtgctagtgggtttatgggcagtcaggttattctgccgtttgcacataccttagagcatgaagagttc

SEQ ID NO: 80281 - DNA, 356 bp, Zea mays
  Clone ID: LIB3088-029-Q1-K1-A8
cggacgcgtggggcatttacagagaacaacttatgtgaggttgtcagaggaattgctggggatcttgttgaggaggtaaaacttattgatcatttcacgaacaagaaaggcatgacgagccattgctatagaatagcctataggtcgatggaacgctcgctcacagacgaggagattaacaatcttcagttgaatgtcagggaagctgtgaaagataaattggaagttcagtttgagatataagcaacttgctatgcagttataccatgaactaaatgttgcctctctttatatgtaaatccattctaaatgatttttttggatctatcaagaaaattgcaccatttgtttctgtt

SEQ ID NO: 80282 - DNA, 419 bp, Zea mays
  Clone ID: LIB3088-029-Q1-K1-A9
cccacgcgtccgcccacgcgttcggtgaacgcaaaacaacaaaatacatgacgaagtacgagggtgcgcgcatcctgggtacgcgagccttgcagataagcatgaatgctccagtcatggttgagcttgagggtgaaactgaccctcttgagattgcaatgaaggagctgagagcgcgcaagatacccttcacgatcagacggtacttacctgatggaagctatgaagactggggagtagacgagctcattgtggaggactcctggaaacgccaggttggtggagactgaagacgcggatctacttggcatggaaagggtatgtggtgcattgggtctttcctgtagttacaagtcttcgttgccactatgaatggatactgttgcgaatgaaccatgacgaaatgatgctattttaac

SEQ ID NO: 80283 - DNA, 290 bp, Zea mays
  Clone ID: LIB3088-029-Q1-K1-B1
ctgacgcgtgggcggactcgtgggcgacggctagctgaagactgtgactgtccgcgaccgcaccgcggggaagaaggtggtgctcttcgccgtgcccggcgcgttcacgcccacctgcacccagaagcaccttccggggttcgtggccaatgccggggagctccgtgccaagggcgttgacaccgtggcctgcgtctccgtcaacgacgccttcgtgatgcgcgcgtggaaggagagtctggggatcggggacgatgtgctgctcctgtcggtcggtaacggttagctgg

SEQ ID NO: 80284 - DNA, 470 bp, Zea mays
  Clone ID: LIB3088-029-Q1-K1-B10
ttcccggatcgacggacggatgcactcgatcgcgagcgcgtgcccttgcagatgttaaggacataaagtgtgtgataaattatgagggtccgggaactctcgaagatggtattcgcatgataggtcgaactggccgtgctggtgctagcggaactgcattcacttttttcacacacgcaaatgcaaagttctcaaggaatctagtgaagattctgcgagaagctggccaagttgtgaatcctgccttagaatccatgtccaggtcttcgaactcaacgggaggaggcaattttcggtcgagaggcagaggtgggtttggtaaccggggccatatgtctggatcaaatacctttcctttaagaagaagaaagccatattgatgtgtgcaaaagaactgtgggagtatgggactatttgtatactactcgggattaagtgcattcttttgggaaatttctgagaaatttccc

SEQ ID NO: 80285 - DNA, 423 bp, Zea mays
  Clone ID: LIB3088-029-Q1-K1-B12
tcgcggacgcgtgggtttgcagatgtgaaggacataaagtgtgtgataaattatgatgttccagcaactcttgaagagggtattcacaggataggtcgaactggccgtgctggtgctagcggaactgcatttacttttttcacacacgcaaatgcaaagttctcaaggaatctagtgaagattctgcgagaagctggccaagttgtgaatcctgccttagaatccatgtccaggtcttcgaactcaacgggaggaggcaattctcggtcgagaggcagaggtgggtttggtaaccggggccatatgtctggatcaaatacctttcctttaggaggaagaaggccatattgatgtgtgcaaaagaactgtgggagtatgggactatctgtatactactcggcattaagtgcattctttgggaaa

SEQ ID NO: 80286 - DNA, 324 bp, Zea mays
  Clone ID: LIB3088-029-Q1-K1-B2
ggagcgccaagacccccggtgacatgtccaaggtggttgaccctgcgctgctggcctagatggcagaggtggcgagcgacgaggaagaggcatacgccgatgacacctactgatcgctcctgcatgcagctcagcagctgctcagtcatggtgttcagtccttcgtgctgcatacatggcgccgccgagcgctcgagcttaacccgtgcgtgtgatgactgatgttgtatttgcactctttacgctgtttgtataattaaagtctgtacaacgctgtacaattgcagattgccttgtacagatgaactagcgtgcagtgaaaaa

SEQ ID NO: 80287 - DNA, 252 bp, Zea mays
  Clone ID: LIB3088-029-Q1-K1-B3
acgtccactcgtccgtccacacgtcctttaacttatccatttaacttgcataataaaaaaatggaaaatatataaattaaaaaattataatataatatttatttaataaatattatttatattttatattttctaattttttatttttttttataaattaatttatattatatttttcctttcttttatttattctatttttatttatcttttttttatattttatttcctattttttattttttcttattt

SEQ ID NO: 80288 - DNA, 193 bp, Zea mays
  Clone ID: LIB3088-029-Q1-K1-B4
gggcatgcgggcaacgttataggggatccaatctaatcacctacatccaactaactgatcgttgttttacaacgtcacctctgttaaaaccattggccttcctaactcaacgtccttactggaaaaacccctttcttcccctacctaattagctatatagcccatcaccgattgcccatttgaccaattttcc

SEQ ID NO: 80289 - DNA, 237 bp, Zea mays
  Clone ID: LIB3088-029-Q1-K1-B5
gtcacgcgtccgcgcacgcgttcgatttttcaaatcttttttctctttacagggagaattgcacttgcggtagaacagtacaatgcattctattaatactattagcagtgcaataatatgtttcatacattctatttttgaagttccagacatcattaatcaatttataacttaatttatgaaatggagatttatatattgttcgtttgtttctatgtttacatatgttttttacgg

SEQ ID NO: 80290 - DNA, 358 bp, Zea mays
  unsure at all n locations
  Clone ID: LIB3088-027-Q1-K1-H12
gccggacgcgtacgcccacgcgtccgcccacgcgtgcgcccacgcgtgcggccacgcgtncgcccacgcgtgcgtggtagatgattatgcgagcgtggggacatggatcanagtgaaccatcaaatggtattggtggattaatcttgtggatgcatcaagccagcaccagaatgagagatactatcatctaacaaccctaacatagtgtttatcccaggcaagctccggtgcatttgccacctccttgttattttaaaacttttatcacttatatgttgcattangtgatagaggttgagtgatgaaacaattgatgcattaccattccttgaaatttaattatcttcattgatacct

SEQ ID NO: 80291 - DNA, 273 bp, Zea mays
  Clone ID: LIB3088-029-Q1-K1-B8
gctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgttaactccaagatcctatccaaggtaatcgagtactgcaacaagcacgtacatgcc

SEQ ID NO: 80292 - DNA, 386 bp, Zea mays
  Clone ID: LIB3088-037-Q1-K1-D4
cccacgcgtccgcccacgcgtccgggctcgggcactgcagcttggtgtctgcttgtttggagtggcaagtggagtttgtatctggagctggaggcgaaggcgaaaatgttgctgccgtcgtcctggcctcctggcctgaactacacaggccgggcggtgcccaatcagtatactgactgacctgcattgcattacatacagagactgcctgctgcttactgtactgtacatctttgcatttgggttcaagccacgttttggtgcttggatgatgtgaagaatggtattggactggtgggggtttctttatctagcaatagcgtacatgatttgatacgacgtacaaaatgactgcttgccagtgaaaatatatccatttgttgttt

SEQ ID NO: 80293 - DNA, 190 bp, Zea mays
  Clone ID: LIB3088-037-Q1-K1-D5
cggacgcgtgggtgacgatgaagatgatgaagagtgattggtttatgtaacctgcaggtgtgctggtgtaatctaccttcatgttgggtcatgatattgcgatggtaactggaaaatgtacagtggatgacaaatgcaccgttccaagtttaagttatttctagagaatgtgactaaatagcctcttgtt

SEQ ID NO: 80294 - DNA, 71 bp, Zea mays
  Clone ID: LIB3088-037-Q1-K1-D6
gagccttctttaactagaatatgggttactgcatgggtctttcacttaaaaatcggggactgctttgttcg

SEQ ID NO: 80295 - DNA, 412 bp, Zea mays
  unsure at all n locations
  Clone ID: LIB3088-037-Q1-K1-D7
gttgctaagctcagcggttctgcagccaagcatggaaagatatatgtgacagctgcggagaagatcatagacaggggctctgactacactaagaaggagactgagaggcttcaccgcatgctggagaagtcaatcagtccttccaaagctgatgaattcatcgttaagaagaacattctttcgatattctcttcgtgaaggtgatgatccacagccacggcctgccagtgacttgaactgatagcgaaccaccactttacggaaaacagaacaaatcggatgatgtgagagaaaggtggtagtgaagtccagtagtggcagagctacttcgtgcacgtagatctcttttgcattttctggttccagggattgacttcgtactcacaagnttacttcacacagaatggttatg

SEQ ID NO: 80296 - DNA, 333 bp, Zea mays
  Clone ID: LIB3088-037-Q1-K1-D9
aattatctgggctcatgctctgcatcgatactagctgctttgtgttggccaatggggtcttcccacttcatgggtcagattaatttgcagcagcaaaatcattcgaacacttgctgctgcatgaactcatccttttcaagtaaaggtctcacaagactactgggaaatggttgggatgacgcaggcatccatgaatttgggttgagcaaagttgaagaaaccacagattggtgtggtctgttctgcatcgagaaaatggaaattataactgtctctcctgggtgaagtgctctcctgagactgggtaaagtacgcaacacctgagttgatatt

SEQ ID NO: 80297 - DNA, 300 bp, Zea mays
  Clone ID: LIB3088-037-Q1-K1-E1
cccacgcgtccgccgaggcgaaccagactgcactggcggagactatgtaatccgtacaggagtcgtcacatatagtacataagaggatgtactgctcatacgacattgacccgagctgagcaccaacgaatcccaggaaccatgccatctgggtcgttattaaccaacacacagtgaagctgacgtgcgaagctgaacagcagccggagcggatccaccattttgacctggccagaaccacccacttcgtgagacctaccaggtggacgaaccatcctacaccaaaatggaagagaacac

SEQ ID NO: 80298 - DNA, 335 bp, Zea mays
  Clone ID: LIB3088-037-Q1-K1-E11
ccggatttccgggggggacgaacccttccgccaacccttccgccaacccgtccggggtaaaaatgaaccatgttattctggccgggcttgcaaaccttgtcgggaaaaaatgaggaggaccaacctgattgacaggttcctggaattaagttcagttatgaatcctggtaaggaagcaaagttagataaagtaaatatattgagtgatgcagcccgtatggtggcacaacttagaggtgaggcagaaaagcttaaggaatcaaatgagaagctgcaggagaatatcaaggatctgaaagaggagaagaacgagctccgtgaagagaaagtgagac

SEQ ID NO: 80299 - DNA, 294 bp, Zea mays
  Clone ID: LIB3088-037-Q1-K1-E12
cccacgcgtccgcgctcgccgtcgatcgtttagtttctctcgtgcacgtgcatgcgtgggcgactgtctcaggccggcggtgcgccggcaccgctcgcatcgtttgcttttccttggaccagcagtcttcaccgtcaggctgagctgcttgtaaccgtgaatccggacccgtttgcttctgtaagatttgtgcatctgcctgagtgtaaagcaaaaaaactaaaaagaaatcaaaatgagaagctgaaggaaaatattcaaggatctgaaggaagaaaaaaaacaagctccgtg

SEQ ID NO: 80300 - DNA, 271 bp, Zea mays
  Clone ID: LIB3088-037-Q1-K1-E2
catctcaccatgcgtgcacagcgaggtctccttttgccctcccgaatgcaaagtttgaaaggctcgtcgacggatttgggtctccttttgcccacccgaatgcaaagtttcgaaaggctcgtcgacggattgggctcttcggctactgcattcttccttatttcatttgatttgctattcttgttgcatgtctgtatatgcatctagtgtcttctcaaatgtcactttgtactttgtgtgaacctgtatcaaacttttttttgttggattc

SEQ ID NO: 80301 - DNA, 350 bp, Zea mays
  Clone ID: LIB3088-037-Q1-K1-E3
gttggcttctcctccccctccggttcgggttcgggttcgtgaggttctccggggttcgggttcgtgggtgagcggatcgagatggcggcgtctgatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccattcccgcggcggccg

SEQ ID NO: 80302 - DNA, 430 bp, Zea mays
  Clone ID: LIB3088-037-Q1-K1-E5
cgaacttaggaaggcaaagaagaaaatgggggagcaaaatatacaaaaggctgtgaagtccgcaatggatgctgcagaagctgctctttcaggaaataaaccgttttgtgttactcatgtggatgtgggtcttgataccacggctgtccgtgaggcggttatcaaagtcatggaccagaagggtttgcctataatgttattcagcaccgatgaggcatcaaacaaagccgttatctatgctggtgtgcctcccaatgctcctagcggcttcaaggtgttggactggctaacaccttcaattgcgccactcaagggaagaggcggtggcggcaagaacggcgtcgcccatggccaggggagtgacgcttctcagctcaaggaagcaatggcacttgcgaacagcattgcttcaatgaagctctgctgattg

SEQ ID NO: 80303 - DNA, 293 bp, Zea mays
  unsure at all n locations
  Clone ID: LIB3088-037-Q1-K1-E6
cgaacccttggccggacccttggtcggccccgtggccggacccttggccggacccgtgggttgtttttcatttcatgcatagtgctgtaaattgcacccttgctgtgaaaatttataatccttgtcgtctgttgtaccttacacttcagtttaggatgtgctgacaatcagtgagcttattatgtccaaataagctctcttttttttaacgtttgatttttagtcnnaaaaaaaaaaaaaaaaaaaaataaaaatttaaaaaaaataaaaaaaaaaaaaaaaaaatttaaaaa

SEQ ID NO: 80304 - DNA, 354 bp, Zea mays
  Clone ID: LIB3088-037-Q1-K1-E7
aacaaaagctctcgatctcaccgacaccgaggaagaagagatcaatggcgtccgaggagggagtcttgatcgcgtgcgcacagcaaggctgattttgactcccacatgaccaatgcccaggaagccggcaagctggtggtcattgacttcactgccgcctggtgcggtccatgccgctccatcgccccactgttcgtcgaacacgccaagaagttcactcaggtcgtgttcctgaaggtggacgtggaccaattgaatgaagtcaccgcggcctacgaggtcgaggcgatgccgaccttccacttcgtcaagaacggcaagacggtcgcgaccattttgggtgccaagaaggac

SEQ ID NO: 80305 - DNA, 294 bp, Zea mays
  Clone ID: LIB3088-037-Q1-K1-E8
aaaataaataaaaaaaaaaaatataattatataaaaaaaaaatacaaatcttccaaaggagagtaaacaaatttgggtgggctttcatccaccctaaatacatattttataaaggctcctaaactgattaaactcttcagcttcttaattcttccttacttcatttaatttgctattcttgtttcatatctgtatatgcatctaacttttttttaaaatttaattttttccttttgtgaacctatatcaaactttttttttttggattcatccctttatatctaataaaaataa

SEQ ID NO: 80306 - DNA, 407 bp, Zea mays
  Clone ID: LIB3088-037-Q1-K1-E9
cccacgcgtccgcccacgcgtccggccaatcaggttactttccacaggaagaagaatgtgcagtactatgaaatgtggtgccaagagcaactacaactttgagaaacctttcctgtacctcgcaaggaagctggctggtgatccgaaccttcactttgttgaagctgttgctcttaagcctccggaagttaccatcgacatggctatgcagcagcagcatgaagctgagcttgctgcagcagctgcacaacctcttcctgatgacgatgatgatctgattgagtagaaaggatcatgagtcttgaacttgagcaggagttgtgccttgcgtgttttaaagtgttctagggtgaactcttgagttctcattgtctggatcatctttttctccttggatgtggtgcatc

SEQ ID NO: 80307 - DNA, 395 bp, Zea mays
  Clone ID: LIB3088-037-Q1-K1-F1
aaaactaataaaaaaaagggagttttcaaaaatcatacgcccccccacctcctcaatactccaaaataaaaaaaccactaacctaaaaaaaatatcaaacaaccaaactacgtgccccccccccttttattccccaaactttctccccccccctcccccctcatatccctttcttattcccccccaatttcaatccccctccccccctttacccccccccttcccctataaacccccctccctccccccttttttccccctcctccccccccccctttcccccacctccccttttcccaaaaatcccccccccttccccccccccccccttgtcccccccctatttcccttatttttccccccccttttctcccccttatacccccccctttttt

SEQ ID NO: 80308 - DNA, 53 bp, Zea mays
  Clone ID: LIB3088-037-Q1-K1-F10
aattcccggggggcccactctcctcccactctcctctctcctactttttttat

SEQ ID NO: 80309 - DNA, 422 bp, Zea mays
  Clone ID: LIB3088-037-Q1-K1-F2
cccacgcgtccgcagcgtcatatttgagcaactatctgtcatatataatctgccaaagggggttatttcttcgtttactcttatactcccgtttttcccaactgggacttctgagcgcatggaagatgagggagatgttgcaaccgcctttacacttgccagatttttgtcaaatataccaatatcacgaggcggaccatcgagtttagtaattttcgatatccatgctttgcaggagagattctactttggagactcagtcttaccatgttttgagagtggcatccccttgctgaaaagtaagcttcaggagctacctgattcccataatataactatagcatttccagatgacggtgcatggaaacgcttctataagcagcttcaacattttcctatggttatatgtaacaaagttagag

SEQ ID NO: 80310 - DNA, 435 bp, Zea mays
  Clone ID: LIB3088-037-Q1-K1-D3
cccacgcgtccgcagaagttgtttctaatgtgctattgagctccattgtgttttggcctacgcaatcttgttctccagtctgcctccaagaaaagctctatagtcccatagtttctgctaaggttcaacaacttcaggatcaattataggctgagaagcaagaaaaaatggacttcgtgatgaagcggaaaccattgatagtatgaagaggttgatggaagaaaataacaaccttcttcgtcaactataaagcttcaattgaagaaaagtgcctccatcttaagtttggttgactactataggacatgcagccttgtggtagctatagtagtagtagatatttatagttgctctagatttgaagttataggattatttttaattatgtttaatgtttaataatttgagttgaagttataagatttgctttgaatt

SEQ ID NO: 80311 - DNA, 375 bp, Zea mays
  Clone ID: LIB3088-037-Q1-K1-F3
gtcctctggcttcaggagtactatctggaaaatatggcaaaggggacatacctgctgatagcaggtttgccctagacaattacaagaacctggcgaacaggtccctggttgacgacacgcttcgaaaagtgaatgggctaaaacctatcgccgctgaacttggcgtttcgttagctcagctctcgattgcttggtgcgcgtcgaaccccaatgtctcgtctgtgatcactggagccaccaaagaaagccagattgtggagaacatgaaggccctagatgtcatcccactgctgacgccggaggtcgtcgacaggatcgaggcggtggtccaaagcaagcccaaacgcaacgtcgagtcatacaggtgaaaattcg

SEQ ID NO: 80312 - DNA, 414 bp, Zea mays
  Clone ID: LIB3088-037-Q1-K1-B4
tgacaggtatccaataaaaacgatgaccttaatcgaaaattttgctgatacgctgatgcaggacttagggtctactattgctatcgatgtagacaacggattgcaaatgggaaaaatggtataaaaacgctggatatttttttttgcctaaactacagctgtgctacagcaaattttgcttaaaagcagaaaaagtgatctatggttttgctgacaccaagctgggaaataggaagactgaatcgacctcttaagcggggaatgtatccttttttgctgccacatataaaatgctacccatgcatacctgggcaccttataacttatgtttggggatttgctacaaagatggtttcaatatataggggtactagaatgtctgtggaaaactaccgtataacgcacatttgagtg

SEQ ID NO: 80313 - DNA, 281 bp, Zea mays
  Clone ID: LIB3088-037-Q1-K1-B5
ttggatatataagttcctggtttagcctaatttatagatcacgacccatcaactggaggggtttttaacatcttgctgttggtcctttgtcgttgcagcctttagacaatcgacaatatgataacaagagttatcttgaaagtagtcttcatttacttttgttttctccccattgtgttgctttgtaattaaactctagccttttcgtttagttatttgaaattgtgtcgtctagtagaacaactgtagtgaaaagaaaatgtcagatagccaccttagtt

SEQ ID NO: 80314 - DNA, 267 bp, Zea mays
  Clone ID: LIB3088-037-Q1-K1-B6
tcttggtttacccttatttatagatcacgacgcatcaactgtatgggttggtaacatcttgctgtggggcctttgtcgttgcatcctttatacaatcgacaatatgataacaagagttatcttgaaagtagtcttcatttacttttgttttctccccattgtgttgctttgtaattaaactctagccttttcgtttagttatttgaaattgtgtcgtctagtagaacaactgttgtgaaaagaaaatgtcagatagccaccttagtt

SEQ ID NO: 80315 - DNA, 412 bp, Zea mays
  Clone ID: LIB3088-037-Q1-K1-B7
cggacgcgtgggcaaaaagtcagaatgacagtgctgatgactgcagtggtgctggggaaaggaaaaagaagaagaaagagaaatcatctgccgggacttcagagaagactgatgcatgaagtgcacctgctgaggctgatggtgccaagggaaagaatggtgctgtagaaacagtcaaggatgataatgagaaaaaggccaaaaaaaagcggaagaagtctaaccctgaagaaactgttcatgtggaaggtaaagaggctgcagggaaagattcaatcccaaaacaagatgatgcgaacaagagtgtaatggagattgaagaaggtaaccaagggaagtcgtcaaatgaaaatgcagttgctggcaaaaaacggaagctagaagaaattgagggaacatttcccctgtgact

SEQ ID NO: 80316 - DNA, 253 bp, Zea mays
  Clone ID: LIB3088-037-Q1-K1-B8
cggttcggcgggggcgtacgcttgcgaagaagacaaagaactgtctcttgttccttcaatgcttgatccttgctattgtggtgcggttcctagctggggtgggtgatcagtttgggtttatctgcatatgatgggggtgacttgggtggcttcatcagcatggaaatagattattcgatggcgatgcatagttcccttttgctaacaactgcttaaaaacgctctgggggaaggctggattacgagaattctt

SEQ ID NO: 80317 - DNA, 364 bp, Zea mays
  unsure at all n locations
  Clone ID: LIB3088-037-Q1-K1-B9
cccacgcgtncgcccacgcgttcggccaagccttccgccacgccttccggcccccgaccagctgaggaaggaggggaagacggtccgcgtcctctcgttcgtctcctgggaactctttgatgagcagtcggatgagtacaaggagagcgtcctccctgccgccgtcacagcgaggatcagcatcgaggccgggtccactctcggctggcagaagtacgtcggagcccatggcaaggccattggcatcgacaagttcggcgcgagtgctcctgccgggacgatctacaaggagtacggcatcaccgtggagagcatcattgcagctgccaaaagctttaagagctaacaacggtctgagtttttt

SEQ ID NO: 80318 - DNA, 76 bp, Zea mays
  Clone ID: LIB3088-037-Q1-K1-C1
ctctaaaaaaaaaaataaattccatgaaaaaaaaaaaaaaaaaaaaaaacgcaaaaaatggggaggggcctaccta

SEQ ID NO: 80319 - DNA, 336 bp, Zea mays
  unsure at all n locations
  Clone ID: LIB3088-037-Q1-K1-C12
tcgtccactcttgggtccaggcgtccgatccgttccttccaagccaagccaaggcanaaaaagaagaggaataggaggaagaggaggcgttcccagcatgtctgaggggactgccaactgcgtggacatcctgatcgccatcatcctgcctccgctgggggtgttcctcaagtacgggtgcggccacgagttctggatctgcctcctcctcaccttcctcggctacatccccgggattatctacgccatctacgccatcaccaagaacaactagctagtcatccttgccgacgacgatccatgtctctgtatctgcgtctgttcatatgcctgatg

SEQ ID NO: 80320 - DNA, 393 bp, Zea mays
  unsure at all n locations
  Clone ID: LIB3088-037-Q1-K1-C2
cccacgcgtccgctgcgcctccgctgcccatcgccgtccccgaccgcagcgcangactgaggatgagtgaagaggataaggctgctgcttctgctgagcagcctaagagggcccctaagctcaatgaaaggatcctctcctctctgtccaggaggtccgtagctgctcatccatggcatgatctcgagatcggtcctggtgctcctgctgtattcaatgttgttgttgagatcacaaagggaagcaaagtcaaatacgagcttgacaagaaaactggactgattaaggttgatcgagtcctttactcatcagttgtataccctcacaattatggtttcattccaaggactctttgtgaagacaatgacccaatggatgtgttggtcctgatgc

SEQ ID NO: 80321 - DNA, 202 bp, Zea mays
  Clone ID: LIB3088-037-Q1-K1-C3
cggacgcgtgggcggacgcgtgggtctggaaacaacaaagtttcccatgttggctatattgtggctgacacgtaataaaggtcattccaaaatgggaaccccctgaatgatttgtcaatgtaaacatgattgctggtccttgtatactgtggcttattattcacatcaattaaggataatcctgattggagcttatcggtgc

SEQ ID NO: 80322 - DNA, 126 bp, Zea mays
  Clone ID: LIB3088-037-Q1-K1-C4
cccacgcgtccgattttctcatatgtttaaactcagaggacagttcctcagatgtttaagatcagacgagagtggatcatagtttttttccttagtgatgattcctggctgctatgtgccttcttg

SEQ ID NO: 80323 - DNA, 279 bp, Zea mays
  Clone ID: LIB3088-037-Q1-K1-C5
cccacgcgtccgtccacgcgtacggaccatctttgctgcttgtctatgctgagaataaatgtgaacggtgcccctggacgctggatccatgctggttttggacacgctgtctttttgtgtttaacttatctgctgccgtcctgtaacgaattcgcaagttttagttcttttgtgctttgttaaagaataaacaatgaggtttcaaaagaaaaaaaaaaaaaaaaaaaaaaataaaaaacacataattacaaaaaaataaataatttatggggggccctt

SEQ ID NO: 80324 - DNA, 432 bp, Zea mays
  unsure at all n locations
  Clone ID: LIB3088-037-Q1-K1-C7
cagcgaatcttggtttccatgtttttaaaaccaatgattttgccccacaatctggctcgggcagcattactaaagaggatggattaatcaaaagagcatttgatcttctaggattctcggatggggatgtgcaggaaacatctgaattcgatctagtcttcatgcatgttgccatggagaacacaagcagcaagttaggaaagttaggaatgaagacagatatcaatcggctcgacaaattagttggtgcagtcttggaatctgcgcctgttggttcagctattgcttcgcgtattcatgtatctgtgattttgagctatgggtctgcttctggaaataaggatgagttntcccttttaacctcttcaaccgaaacagattcagacttgaatctactgcgtccacgccagagctacacaatgaaaacagggg

SEQ ID NO: 80325 - DNA, 428 bp, Zea mays
  Clone ID: LIB3088-037-Q1-K1-C8
cttatcatccccatccgcacctctctccatctccctgctcctccgcctccttctgggtccagccaagccagggatcggcatgtcggactcggaggagcaccacttcgaatcgaaggccgacgccggagcgtccaagacctacccgcagcaggctggcaccgtccgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccacctgattgatatatcagaggatggatttgtgagccctcttactgtagatggcaacactctggatgatctta

SEQ ID NO: 80326 - DNA, 275 bp, Zea mays
  Clone ID: LIB3088-037-Q1-K1-C9
cccacgcgtccgcgactctcgagtggtgtttgcgttagacagccagccactgtgtggctggtgttccaacattggggaggctgcttgcgcgaggaagtgggggtgactgactcaagagaagggcctggtcataggctgctgcattatgaattcctgaccatgtctaatgtctgacctctgaatcaactttgtataaaacctaatctcctttctccctgaatgaatgaatcattattggcttgctttgctttaaaaaaaaaaatacctacttatta

SEQ ID NO: 80327 - DNA, 414 bp, Zea mays
  Clone ID: LIB3088-037-Q1-K1-D1
gggataacgtccaagtggatatctcaactgatgctggccttggcaccgtgtactctgtgtcagttcctgtgcgccgtgtgaagccagagtaccaggaatctgaagagcagtacagagggaaaattgttggtgtcgacttcaaggacactggagaatcctcagggagcgttgacgtcacctttgacttctttgtacccaatgagaactaattccctggacttctatcagagtgtggtctgcaatgtttcatctgttcgttgaatttgtgagccctctgggtagaaagttagaatgctttgttctctacagtgatgtaaatatctagggtccctgtttgctccatgtttcctgtaatttggttctggaattttgtcagagacctgcgttggtaggttcttggtaaaaccataacta

SEQ ID NO: 80328 - DNA, 336 bp, Zea mays
  Clone ID: LIB3088-037-Q1-K1-D10
tcgttcactgcatcttagcgtctactggtgtggagtgacaagtggagggggtagctgcagctgtatgcaaatgcaaaaatattacttccatcgttctacaaatccacccttccaagcttaagttatttctagagaatgtgactaaatagcctcttgttcttgcattacatacattaaactgtcttctcctttttaaaaaaatcaatataatataaaaaaaatttaattattataaaaaataaaaaaaaaaaaaaaatcttttaaataaattaaaaaggccgccccttttaaaaatacccaattttacttccccttccttccaactttaaaactttt

SEQ ID NO: 80329 - DNA, 392 bp, Zea mays
  Clone ID: LIB3088-037-Q1-K1-D2
gcctcaaatcgctccctgcctctggtcacctcgcttccgctcccggctcccctccggctacccagacatcgtccgtgcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccgcaagatgaaggacaccgactccgaggaggagctcaaggaggcgttcagggtgttcgacaagga

SEQ ID NO: 80330 - DNA, 398 bp, Zea mays
  Clone ID: LIB3088-037-Q1-K1-B2
gtcgcgaagaagacaaagaactggctcttgggccggcaaggcttgatccttgctattgtgatgctgatcctagctttcatccttcatcagtttgggtttatcggcagatgatgggggtgacttgggtggctgcatcagcatggaaatagattattcgatggcgatgcagagttccctcttgctaacaactgcttaaaagcgctttgggggaaggctggattacgagaattctttgtatccgtatcttatgaaagtgtaactctgtccataaagctatttcatcctatttttaccagcaaaggtagtagaaaggaatcgagccgaaactgttgtgataacaagccgacatgtaatatgataatatccttgtggtgctttcagttttaagtagcagtttt

SEQ ID NO: 80331 - DNA, 410 bp, Zea mays
  Clone ID: LIB3088-045-Q1-K1-B4
agcgctcaagttctcgcgcccacagccaaatttttctccactcaatcgcggcataagctgcactgcagccatggacgccagcggagccggtagcaaggcgaagaagggggcggctgggcgcaaggctggcggccccaggaagaagtcggtgtcgcggtccgtcaaggccgggctgcagatccccgtcggccggatcgggcgctacctcaagaaggggcggtacgcgcagagcgtgggcaccggcgcccccgactatctagccgccgtgcttgagtacctcgacgacgacgtgctggagctggccgggaacgcgtcgaaggacaacaagaagacgcgcatcgtgccgcgacacttgctcctggcgattcgtaacgacgttgagctcggcaagctgctgtctggcgtcacca

SEQ ID NO: 80332 - DNA, 130 bp, Zea mays
  Clone ID: LIB3088-045-Q1-K1-B5
gtgcatacttgaactgtcagctaacactgagtatttcaccttgtcatccaatgtattctggtacttggtaaaatcttacaccatcctgtaaataactgggttgttgtaataatatatgcttttgctacgc

SEQ ID NO: 80333 - DNA, 424 bp, Zea mays
  Clone ID: LIB3088-045-Q1-K1-B6
atggtcatatcataatggtggatcttggcccaccctattatggcagttcacactggcgtgcataaaaatgggtagaccagaattggcccggagggccattactgtggccgaggagagactgtcagatgacaagtggccggaatactacgacactcgatctgggaggttcattgggaagcaatcccgatcttatcagacatggactattgctggttttctgacctcaaaaatgttgctggagaacccagagctggcttctattctgacctgtgatgaggaccttgagctgctcgaaggctgtgcttgctgcctgtccaagaagaggacaaggtgctcacggcgagcggccaagtcacatgctgcgtgaaactgtgaagcttattgtgttcttatactggtgatgcacaatgtgtactaccaacgg

SEQ ID NO: 80334 - DNA, 412 bp, Zea mays
  unsure at all n locations
  Clone ID: LIB3088-045-Q1-K1-B7
catcattgaggcactgtctgagtttgttgagatagaatcaagggataacgtccaagtggggatctcaactgatgctggccttggcaccgtgtactctgtgtcagttcctgtgcgccgtgtgaagccagagtaccaggaatctgaagagcagtacagagggaaaattgttggtgtcgacttcaaggacactggagaatcctcagggagcgttgacgtcacctttgacttctttgtacccaatgagaactaattccctggacttctatcagagtgtggtctgcaatgtttcatctgttcgttgaatttgtgagccctctgggtagaaagttagaatgctttgttctctacagtgatgtaaatatctanggtccctgtttgctccatgtttnctgtaaattgggtctggaatttg

SEQ ID NO: 80335 - DNA, 428 bp, Zea mays
  Clone ID: LIB3088-045-Q1-K1-B9
cccacgcgtccgcccacgcgtccggatacaagcagttgtccttgatatgtcaagtgtggtgaacatcgacacttcaagactcactgcactggaagaaatacacaaagagttggtgtctcttggcttacagatggctatagccagtccgggatggaaggcagttcagaagatgaaagtgtcacaggtggtggacagggtaggacaggactggatcttcatgacagtaggtgaagcggtggatgcctgtctagctgctcataagggcacagctctcgcatgttgagtatgcgttaattactactattagtactcctaaagataatcccataagcgatgcgggtatttgcatcctatgaaagtgttactggaaatgcttacgaaacagaaatgcatggtatgacttgactggagtggtcgtggcgagtaat

SEQ ID NO: 80336 - DNA, 308 bp, Zea mays
  Clone ID: LIB3088-045-Q1-K1-C1
cggacgcgtgggggcacgggcgcgggcatgggtgccggcgctggaaccggagcaggcacgggcatgggcgccgggacggggaccagcaccggagctggcgccggcgccgggatcacgacccccggggccctgagcccgccgttcggcggcacgggcgcctacggaccggcaggagcaggcagcaccgactacagcgacgctgcggcgccgcgcgtgtgcaggctgcacgtggtggtcgtcctcggcctcggactagtcgtcgccggcgcacctatcctacggtaggaggtgtaagtgggacggaaggg

SEQ ID NO: 80337 - DNA, 369 bp, Zea mays
  Clone ID: LIB3088-045-Q1-K1-C10
attcaaagtcacagcggcgaaactctcggcgatgtctggccgcggcaagggcgggaaggggctgggcaagggcggcgccaagcgccaccgcaaggtgctgcgtgacaacatccagggcatcaccaagccggcgatccgcaggttggccaggaagggcggcgtcaagcgcatctccgggctcatctacgaggagacccgcggcgtgctcaagatcttcctcgagaacgttatccgagacgccgtcacctacaccgagcacgcccgccgcaagactgtgaccgccatggacgttgtctacgctctcaagcgccaggggcgcaccctatacagcttaggcggataggtcgaccatctaccggtggcgaatta

SEQ ID NO: 80338 - DNA, 442 bp, Zea mays
  Clone ID: LIB3088-045-Q1-K1-C11
ctcttactcagagataattaacgagagcctgatcgagtccgtggactcgttgaacccgtgcatgcatgctcgcggtgtggccttcatggtcgataactgctccacaactgctcgtttgggatctaggaaatgggcaccacgcttcgattacatcttgacccaacaggcgtttgtgactgttgacaagaaagcaccgatcaaccaagacctcatcagcaacttcatgtctgaccctgtgcacggtgccatcgaagtctgtgctcagctgaggcccaccgttgacatctcagtgaccgctgatgcagatttcgtgcgcccagagcttcgacagtcttcataagcttgtatggatccgcagtgtgactgcaatggctagtttgtaagaacttaatatgcctgggcttttgaactcttagattgtgcttgtattgctcgtgcttga

SEQ ID NO: 80339 - DNA, 411 bp, Zea mays
  unsure at all n locations
  Clone ID: LIB3088-045-Q1-K1-C12
attccaaagagcccctgtgctgttgggaacgaaaggataggcgaagcttatgcgaaatggggtcgaccgaatccttgccggatacctgcatacactaatctaacgtctaagattgctacggtctggatcagaacctggaaacctacaaaggtaaggaactacttgttgttaacgctgcctacaaatgagggttcactgataccaattacacgcaagtgacggagctctatcagaagttcatgaccttacactctgatatattgacattcccttgctattagtacttgcgaccggatccaggttctgatcaccagatacatgactcagctagcaccagatttaaagctgaatacccagtttttcagaaggtgcgcgtaaacgggccatatgcggcgccngtttacaagtttc

SEQ ID NO: 80340 - DNA, 187 bp, Zea mays
  Clone ID: LIB3088-045-Q1-K1-C2
cgttccaggagttcaccgacctcttggctaagccgacaaagggtcttctgatcgaggctcccaccgagacagtggaagcttgaacgtcttagtttactgttccaagtgtcgcgaaaagagttttctgtactagctacatattttaaatgttattttgaattatgatgagaaaccaaggtatgcaccc

SEQ ID NO: 80341 - DNA, 268 bp, Zea mays
  Clone ID: LIB3088-045-Q1-K1-C3
tgcagatcgagggggtgaacaccaaggaggacgtcgcgtggtactgcgggaagcggatgggctacatctgggaggccacgaccaagagcagcggcacccactaccgctgcatctggggcaaggtcgcccgcccgcatggcaactacggcgtcgtgcgcgccaagatcaagtccaacctgtcgccggaatccatgggccgcaacgtcaaggcgttcatgtaccccagcagcatctaatgataatctgaatgcgtggaggacacctactc

SEQ ID NO: 80342 - DNA, 206 bp, Zea mays
  Clone ID: LIB3088-045-Q1-K1-C4
atcgcgagcgccgcccttttttttttttttttttttaaagtatcttctgaactaaacagcaccatttcggagttatcttaaactatataaaaaaactgaactcactattcatcaaaataaatcatttcaaaaatctacataaactaaaataatattaacaaatataaataaaaaacgccagacttctttaaaatatccaattttac

SEQ ID NO: 80343 - DNA, 356 bp, Zea mays
  Clone ID: LIB3088-045-Q1-K1-C5
cggacgcgtgggggaacattgaacaacgtgccggaggcggtttacatgcggcacctcatgggagtgaacggggtcatcgtcgacctggtgccggagatcaccgaggcagtctgcgagctcatcgccctgcccgagcccgacctggaagtgggcagcttgagcaaccaggcggtagctagaggagccacaactccgaatttctcgcatcgcgagatctcgttcctgctgaggcttattcctgagcttgtccaataatgcctagacttcctggtgtctgtctgtctgtctatcatggatgaattgactaatgtgctactgatgtactgatccgcatacaacaaaagaagcccttgtgc

SEQ ID NO: 80344 - DNA, 431 bp, Zea mays
  Clone ID: LIB3088-045-Q1-K1-C6
cccacgcgtccgcggacgcgtgggctcatggcccctacataaatggggagaacgtgtcagcgactgatcttagcctggggccaaagcttttccacctacagatcgcactggagcatttcaaaggctggaagatcccagaaaacctaaccaatgtccatgcctacaccaaggctcttttcagccgtgaatcttttgtcaagactaagccatccgaggagcacgtgattgcgggatgggcgcccaaggtgaatgcataagagccttgtgctttggtgctacctggtggactccatccatttatcttatcagtctttgtcagtggtgtggataggtgtcaagtctgtagcctagatgcatgattcagttggaattatgcagtgccgtgtctcgagtactcagttctggctgttgcggttgtgcatcttaccttc

SEQ ID NO: 80345 - DNA, 436 bp, Zea mays
  Clone ID: LIB3088-045-Q1-K1-C7
caaaaccctagccctgcttctttgccatggcgagcagcgctagccaggcgagcctcctgggccagaagcagctcaaggatcttgcgaagaaccccgtggatgggttctccgccgggcttgtagacgacagcaacatcttcgagtggcaggtcaccatcatcggaccgcctgacaccctatatgatggaggctacttcaatgcaataatgaccttcccccagaactatcccaacagcccgccatcagtaagatttacttctgagatgtggcatccgaatgtttatcctgatggacgtgtttgcatttctattcttcatccacctggtgaagatcccaatggttatgagcttgcaagcgaacgatggacaccagtgcacacggttgaaagtatagttctgagcatcatttcgatgctctctagtccaaatgacgagtc

SEQ ID NO: 80346 - DNA, 338 bp, Zea mays
  Clone ID: LIB3088-045-Q1-K1-C8
cccacgcgttcgtccacgcgtccgaaaaaaaaaaaaaaaataataaaaaatgtaaaataaggaaaaaaaactaaaaaaaaaaataaaaataaaaaaaaaaaataaaaaaaaaaaaaaaaaaaaaaagataataataaaaaaaactaaacataaaaaaaaaaaaaaataatgggcgtgctttttagaggcccaaggtttggaagactttttatagcaacgaaacgacttcttatatgcacaccttattcaagcccgaggccgcggttttaaaagaggccctggacgaaaactccatgcttgccgacactatagccgctaagccaaaagccacttttatc

SEQ ID NO: 80347 - DNA, 331 bp, Zea mays
  Clone ID: LIB3088-045-Q1-K1-C9
accacgcgtccggtcgagcaagttggtggtatttaccttgttactgccgatcatggcaaggctgaggatatggtgaaaaggaacaaatctggcaagccgttgctcgacacgaatggcggtattcatattctaacctcgcatacccttcatgcggtgctggttgccattggaggccctgggcttgacagggcagtgaaattccagaacgacattcaaattcctgggctcgccaatgtatccgcaactgcgatgaacctccatggatttaacagccccgctgactactagcaaactcctaacgaatgggctaactactaaatacttgccagct

SEQ ID NO: 80348 - DNA, 376 bp, Zea mays
  Clone ID: LIB3088-045-Q1-K1-B3
catcattgaggcactgtctgcttccgctgcgatcgactcaaggtaacgcacactggggtctcaactgacgctggccttggcaccgagtactatgcgtcagttcctgagccccgtcttaagccacagatccaggaatctgaccagccgtacatatggaacattgcaggtgaccacttcaaggacactgtataaacctcatggagcggtgacgtcacctttgacttctttgtacccaatgagaactaattgcctgtacttctatcacactgtggtctgcagtgtttcatctgctcgctgaattcatgagccctctggctagaaagttataatgctctgtactctacaccgatgtaaatatctaaggtccctgtttgct

SEQ ID NO: 80349 - DNA, 283 bp, Zea mays
  Clone ID: LIB3088-044-Q1-K1-H8
cccacgcgtccgccgactcgttggcggactcgcgggtttacatcacgttatgtgtaataggccactttttttgcactgatgttttcatattcaacacagcagacattatgagcattcaggacgcgcatgtcaacaagctgtcaaacagaacgggcacgcttatgtgcgagagcgtcgacgctctgttcaactacatgacccggaccgtgttacactacaccacggggcacgtacgcgacgcgttacaagtggccagacgcttgccgggttcgacggcgcttgt

SEQ ID NO: 80350 - DNA, 372 bp, Zea mays
  Clone ID: LIB3088-044-Q1-K1-H9
cggacgcgtggggtaaagatcatcttgcaataaaaaaaaaaaaaaaaaaaaaaggaaaaaggaaaaaaaaaaaaaaaaaaaaataaaaaaaaaaaaaaaaaaataaaaaaaaaaaaaaaaaaaacaaaaaataaaataaaagaaaacaagaaaaaaaacttatgaaggaacgaaataaaaataatagcaactataacttcacattgccgactatttcaaaccagaaaattttagccggaaacaggttaccacctgagtattagaaccctcctcgaaaagcctacaaacgcaatgccttgtaccaacagctgaagaaaaaacggatttcggacacccaattatatatacccgattcttttagaagcatacccc

SEQ ID NO: 80351 - DNA, 108 bp, Zea mays
  unsure at all n locations
  Clone ID: LIB3088-045-Q1-K1-A1
gtccctcatgcctcnncggtggagttgtcgctagcttttcccgagtatggaaaagatttgtctgtgaaacacacacttggatgtctagattgcanggtagttttcaaa

SEQ ID NO: 80352 - DNA, 387 bp, Zea mays
  Clone ID: LIB3088-045-Q1-K1-A10
gtgggcaaatatgcaaggaaaaaaaaaaactacctaattataacatatactaaataacaagggctaataaaactataaagctaaaaacgagtctaaaaaagcgatggcatacaagaggctgctgctggcggcgctgtgcatggtggcggcggcgctgctcgccgtgcggtcggaggcccacggcctgtaagacttcgcaagcatcgactcaacaccggagatgcagaccttcttcaagcccgaggccgctgcgctcccggaggccctggacgcgttctccatgcccgacgccaccatggccgcgaagccggatgccacgtcgatcccgaccaccaccaccggcaccacagcggcagctgcggtcacctccgccactgcaggcactac

SEQ ID NO: 80353 - DNA, 397 bp, Zea mays
  Clone ID: LIB3088-045-Q1-K1-A11
cggacgcgtgggcgcgtggtacgctggcaagcgcatggcgtacatctacaaggccaagacgaagagcaatgagacccgctacaggtgcatctggggcaaggtcacccgtccgcacggaaactcgggcgtcgtccgtgccaagttcaagtccaacctcccgcctgagtccatggggcgcaaggtcagagtgttcatgtacccgagcagcatctaaggttttgttggagtaaagatggactagaaatggccatgtgtttatttctcacttttctctgaacttaaaatgccttgtgttggtaacttagattgttcaagtgctgaacctgtggaagttgtgccaaaatttgttgtcgaacggatgaactattgtcgtaatgttatgccagcagcagatctt

SEQ ID NO: 80354 - DNA, 323 bp, Zea mays
  Clone ID: LIB3088-045-Q1-K1-A2
gcacaactgcacgaatgtgctcctccgtccgcgtagctctcggattcggcgatgtctgggcgcggcaagggcggcaaggggctgggcaagggcggcgccaagcgccaccgcaaggtgctgcgcgacaacatccagggcatcacgaagccggcgatccgtatgctggccaggatgggcggcgtcaagcgcatttctgggctcatctacgatgagacccgccgcgtgctcaagatcttactggagaacgtcatccgcgacgccgtcacctacaccgagcacgcacgccgcatgaccgtcaccgccatggatgtcgtctacgcgct

SEQ ID NO: 80355 - DNA, 178 bp, Zea mays
  Clone ID: LIB3088-045-Q1-K1-A3
actttttaaacttacgcttgttacactaacatcaacattaagtggaatgcaaacatgttacctaacttctctatgacaacatatatgacactttgtacaccatgctaatatcttttatcttgattatctccaaccacacaatatataattaaaatactactattacattatttaatac

SEQ ID NO: 80356 - DNA, 429 bp, Zea mays
  Clone ID: LIB3088-045-Q1-K1-A5
cccacgcgtgcgcgcacgatcgcaacaccatccacccaccagttcaaaggggagctaacggggaacttgcggcgaaaatctaggccagagccaaggccgcaaagggcttcggaaagggcggcccgaagcttctccgcaaggtcctgcacgacaccatgcaggcgatcacgaagccgctgatccggaggctggccatgaggggcgtcttcaagctcatctacgggctgacctacgaggagacccgcagcgtgctcaagatctttctccagaatgttatgcgcgacgctgagacctacacggagcacacccgtcgcaataccgacaccgctatcgacgtcgtgtacgccctcaaacgccactgtcgcactctctattgcttcagctgctaggttaggcgtgggtaattgcctgtccaggtgtctacgatct

SEQ ID NO: 80357 - DNA, 449 bp, Zea mays
  Clone ID: LIB3088-045-Q1-K1-A6
acaagatctacatcttcaaggtgctgaagcaggtgcacccggacatcggcatctcctctagggccatgtccatcatgaactccttcatcaacgacatcttcgagaagctcgccgccgaggccgccaagctcgcgcggtacaacaagaagcccaccatcacctcccgtgagatccagacctccgtgcgcctcgtcctccccggggagctcgccaagcacgccgtctccgagggcaccaaggccgtcaccaagttcacctcgtactaggctgcgtggcctccgcttgcaggcttccctcgtatgttcgcgtgtcttgctgtagttaggtgctgctgtgtctggtctcctccggtagcaactgttatctgatggaacagtaacaatgcttattgaatccagctagttgcttatttgtggatcctctctctttggtggtggccacctttatct

SEQ ID NO: 80358 - DNA, 365 bp, Zea mays
  unsure at all n locations
  Clone ID: LIB3088-045-Q1-K1-A7
gtccgcgatgatgatgctctacttctcaagcctgggttacattgatgttgtctgggaagaggcacttggtaagctggcgcttgttgcactagcagcaacagtagtggagtgcgtccctgtgaccgaagttgtagatgacaacatatctgttcctttggccaccatgctggtagcttttctcttgtttagctccaaccgcacaatagttaattaaaatactactagtgcattatttaagacatgtgatgagttcttcagtgatgagttgtgcttgcttttgcttcctatgtgaatgtgatctctagtacttgatggcgacagcctaaaaaaaaagantaatggaaattttgacattcttattaaaa

SEQ ID NO: 80359 - DNA, 430 bp, Zea mays
  Clone ID: LIB3088-045-Q1-K1-A8
cggacgcgtgggcgcagccagagtgcagaaatcctagacgacatggtcacgagaagccggggtgagatcaaacgcctgaacagcccgaagatcaccagctcaggtggcacgcctgtggcagaactgaaaggcatccgcagcccatccatttctgaaaaagcatacagccctcgtctcactgagctccagcatgagcgcaaccctctgggagggagaagcaggcctaggacgccatccaagttgggtgaaggctcggcaccaaagtgaataaagcaatgatgcattgcttaagctatgcaactactgggttactggccatcaattatataagtgattataaagtgggttcagtgttagtatccaagatgtcctctgatgagattactactattcatgtgtatctctagcctctttgtctttctctctcttc

SEQ ID NO: 80360 - DNA, 364 bp, Zea mays
  Clone ID: LIB3088-045-Q1-K1-A9
cggactcgtgggctgacgcgtgggaaacaatttaaaaattaacataaaacaaaaaaaccatgaataattcgataaaactaatcaaaaatataatataaccgcatcaaaccaattcatgcttaaaatcccattgcatcttgctttaaggtgtcctcctgtctatcaccctctatctttttctagtccttttcttcatttccaactctgtatcttcctccataatccttcttgttgctcatcctttttaatcctttctgctctttctctctccatctcctcctctactgtgatgcatctagcttttaacctctgtttttattagtaacttgcttttgcctcccatccttcatccttttattatatt

SEQ ID NO: 80361 - DNA, 379 bp, Zea mays
  Clone ID: LIB3088-045-Q1-K1-B1
atcgtggagtatgatctgaaactgcagaaacagtatgttgcttggaaatattctgcaacagcataattttgctccgtcactgttcgtggcttttggtggtgttagggactccaaagtagggttgcaactgatcttacatgtaggcctagtttgggtactcttggattgaagtggtttggagggattgaagagtgtttaaatcccgatagatcaaaaactcccccaatacatctcaatccactccaatccgtctcattcctagagtacccaaaccaagccgtaggggggagagtttcccagctgatgacgcgtatggaagtaagagatcatgtagaggggcattgttttatggaaattttgacattcttttgcaagtttc

SEQ ID NO: 80362 - DNA, 361 bp, Zea mays
  Clone ID: LIB3088-045-Q1-K1-B10
cccacgcttgacgccacgcgttcgtgcacgcatcctcattctgatcaccaaatgctggatggccccaataatggatacctagcaccgcaagtgctaaccgggagctactcatgaatgtagctatcactaaatactgacactgcactgtatccaggctcagatctaaacgacagatactacatcaaaacagcttgcatagagctactactgtgataaaacaccgaacaccggataaatcctgcacttataagtcctggacttgctggaccatggcagattactcatttgggacagcattatatgttactgcatctgcatcaaatctgtataaatggctacactatcctgctacgaatcagat

SEQ ID NO: 80363 - DNA, 351 bp, Zea mays
  Clone ID: LIB3088-045-Q1-K1-B11
cccacgcgtccggtcgggacaatgcttggtaattggtatgttcctgttggaactttctgctctccttcgtaagtggaaattaacttagaaaccggtttaagctaatagccttcgtttctgttttcccttcagtgctgtcagcggattgtggtgtggaaggagttgcttgttcgttctgggccaagtttcagcttgtagagaagaaggcagacttctttgttaatattatttttagcctaaataaaccagcacaatgttagacggtgatgtttctcatttggcatatttgcatgcatgctctgtaatttttttctgcgagctatgtgatggaaatatatgcatcatctttat

SEQ ID NO: 80364 - DNA, 385 bp, Zea mays
  Clone ID: LIB3088-045-Q1-K1-B12
cccagcgcgtccgcccacgcgtccggttctagaccgtgcattaccaaaaaacaatagacaaggcgcaaggtgaaaaaaaaaactgaacaaaaaataataaaagagcgccagtttccaacattatgcatgatgggtactagtactggtgacggccggcgattgatattctggatcagatactagatattggtgacccccgtaagaaggggcttcacttggctaaatagtgtaccacttgtgcatactatcctttgcttactctaccttcttgttccatgtcagttctcaaggtgacccacactacaatcgccgtttgcatgcagtgccctcccttcatggcaaatgaaatgccctttacaccgaacttttaaacgaacccgatcac

SEQ ID NO: 80365 - DNA, 412 bp, Zea mays
  unsure at all n locations
  Clone ID: LIB3088-045-Q1-K1-B2
cccacgcgtccgcccacgcgtccgcggacgcgtgggtccgggttagggttttagacggcgatgggtgcggggggcgacgagaaggctgcgatggctgcgtccgctgcagccgcgggtgccggtgccgccgagggcgagggcgcggtggactccaaggaccttcagcagcagagcaaggcgctcgacaagctcactgatcatgtcgaggaccggcagctcgattcatcccgtgtccaatccgccatggcagcacttgcttcatccaaggaggctgactggaacgcgatgaggctganggagaaagaattggctgctgtgaagatcaaccctgccgatgtcgaaattatcgctactgagcttgagctggacaagaagatcgcggagagaacgctccgtgagcacaaaggtgatg

SEQ ID NO: 80366 - DNA, 437 bp, Zea mays
  Clone ID: LIB3088-044-Q1-K1-G11
agcggcggctcctaagaaggtgtcaacccttaagaaggctgctgctgctgccgccccggccaggaagggcgtggccaggaaggccaagaagtagtctgcctgccttgtcgctggcgagatccccccctcaattccgcctatagattcccctctttcatggattttgatccaatcgtaatattgtcagtagctctagattcgtcggtagctccagcatgagtgtcggtggtagttctgtgcctgtaaaaacttgggatagttgatcgcgtgtgatcagccgtcatgctcctgcagtctctatgaacaagctaagctataatagtattttgctaaaaaaaaaactacctgaaaaaagtcaaaattggctctcttttattttgtatctactactactactcatttgcgagtgagagatggtctgggcacaccattcaatt

SEQ ID NO: 80367 - DNA, 426 bp, Zea mays
  Clone ID: LIB3088-044-Q1-K1-G12
cgtggcgctggcggcgcgcgacgccgtgtcgtaccagttcaaggcgtcgctgtggcaggtggagacggggcggcgcgacggcacggtgtcgctggcgtccaacacgggggcgctgccgtcgcccttcgcgggcttcgcgggcctgctgcagagcttctcggaccgggggctgaacctgacggacctcgtggcgctgtcgggggcgcacaccatcggcgtggcaagctgctccagcgtcaccccgcgcctgtaccaggggaacgccagcagcgtggacccgctgctggactcggcctacgcgcggacgctcatgtcgtcgtgccccaacccgtcgccggcgtcggccaccgtggcgctggacggaggcacgccgttccggttcgacagcagttactactccagggtgcagcagaagcagggcacgct

SEQ ID NO: 80368 - DNA, 376 bp, Zea mays
  unsure at all n locations
  Clone ID: LIB3088-044-Q1-K1-G2
cccacgcgtccggagaaagctagagaagctatttaccgacaaaggaatcctgttccttcccaacgtgggggtgaccacctgattgatttacatggcctgcatgtgaacgaagcaatccacatcctgaggggtgagctcaccgccttgaagagcgcggcgagggcagcaggggagaggatgcaagtcatggtttgcgttggaacaggccaccacaccaagggctctcgcactgcgaggttgcccatagctgtggagcagttcctgctggatgaaggcctncagtacacgcagcctcaggcgggtctgctccgagtgatggtgtactaacatctcttangtgagaaaaaaaaaccttcaaaaaaaaaaaannananng

SEQ ID NO: 80369 - DNA, 425 bp, Zea mays
  unsure at all n locations
  Clone ID: LIB3088-044-Q1-K1-G4
cggacgcgtggggtatcattatcagcacaagcacccacacaatttcgttttcctgggtctgttcacgttgtgcttgagcttcagcatcggtgtggcttgtgctaacacccaagggaaaatcgttctggaggctttagtgctgacggctggcgtggtggtttctctgactgcgtatgctttctgggcgtcaaagaagggcaaggaattcgggtacctggggcctatcctgtcttccgcgcttactatcctcgtcctaactagctttcttcaggttttcttcccactgggacccgtgtcggtgggcttgttcggtgggctaggggctctggtcttctcaggctttatcctgtacgacaccgaaaacctgattaggcgccacacctacgacgagtacatctgggcgtcggntgggctggacctcgaca

SEQ ID NO: 80370 - DNA, 420 bp, Zea mays
  unsure at all n locations
  Clone ID: LIB3088-044-Q1-K1-G8
agttgaccctgatgcttcttcaagattaaataacccagattcttctaaaatggacaccaattttttgaaagaggcctacccattacacacaccaaatccatccagtgtgattgaaactgtgtatgaaccgatggccttggtgacaatctctcccccttttatatgttcagatggttngcttttggcacccgaaattaattctaggccaggaaaattttcaaattgtgaaccatagatggtcacatgctcaaacaatttttttggtaatgccgagcaatctgctaaacttgccagcagtgatgacaggccataggctttcacaatgactgagagcactacaaactgtggggatgaacaattgacagatgtcaaagaacctgtggccagtacagcaaaagaacagttatcgaaagacatcga

SEQ ID NO: 80371 - DNA, 436 bp, Zea mays
  Clone ID: LIB3088-044-Q1-K1-G9
gacgacaagaggatcagcgaggtgccggcgatgaaggtctgcgcgctcaggttcactgagacagcgagggccaggatcatcaatgctggcggagagtgcctcaccttcgaccagctcgcgctccgtgccccacttgggcaaaacacggttctgctgaggggtcctaagaacgctagggaagctgtcaggcacttcgggcctgcaccaggagtgcctcacagccacaccaagccttatgttcgctcgaagggtaggaagtttgagaaggcgagaggaaggaggaacagcaggggcttcaaggtctaagtggccactgccttgccaatctagtgccgttttgctcgtgtcagctcaatattaccgttttggtgtcatagttgtaatgttttagttgtcggaatctcgtgtcattatcggatatcgaaccaatcaaatt

SEQ ID NO: 80372 - DNA, 274 bp, Zea mays
  Clone ID: LIB3088-044-Q1-K1-H1
ccgcggcggcgtgcctgtgcaccgccatcaaggccaaggtgctggacatctccgtctacgtgcccatcgcgctggaggtgctcgtcaactgcggctgcgaggtcccgccaggctacaaatgcacttaaacgactccattccatttcatcccatctcaccatgcgtgcacagcgaggtctccttttgccctcccgaatgcaaagtttgaaaggctcgtcgacggatttgggtctccttttgcccacccgaatgcaaagtttcgaaaggctcgtcg

SEQ ID NO: 80373 - DNA, 412 bp, Zea mays
  unsure at all n locations
  Clone ID: LIB3088-044-Q1-K1-H10
atctcagcactccaagtatttctgtgagttctgtgggaagtttgctgtgaagaggaaagcggttgggatttggggatgcaaggactgtgggaaggtcaaggccggtggtgcttacaccatgaacactgctagtgcggtcactgtcaggagcacgatccgtcgcttgagggagcagactgaagcatgatcggtcgcttgtcaggcatactggggtccactatattggctgtgtagccgagacagtactccagcatttttgggttatgctctaggatctctaaaggttgggtgctaagatttctacttgtttaccgttgtgaatttcacaagtgatatctgatcctattactatcatgatgacgtcaaatttgcttctaaaaaaaaaaaanttttaaaaaataacattttanac

SEQ ID NO: 80374 - DNA, 436 bp, Zea mays
  Clone ID: LIB3088-044-Q1-K1-H11
tctctcaacttcctttggcttcaggcaagcaaaagaggattgctgtgattactcaaggtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttctcttctgatccggccaatatttttgccgtgaaatttg

SEQ ID NO: 80375 - DNA, 442 bp, Zea mays
  Clone ID: LIB3088-044-Q1-K1-H12
agccgccatatctcacgatccactcgagctccaagccgagggaaggtgaggagcgatggcgcgcggcgtggtgtcggcgaagggcggcgcggtcgcgggcaagaagaaggggtcggtttccttcacgatcgactgcaccaagccagtggaggacaagatcatggaggtcgcctcgctcgagaagttcctgcaggagcgcatcaaggtcgccggcggcaaggctggcaacctcggcgactccgtcaccatctctcgcgagaagaccaaggtcaccgtcacctctgacggacccttctccaagaggtacctgaagtacttgaccaagaagtacttgaagaagcacaacgtgcgggattggctacgcgtggttgctgccaacaaggaccgaaacgtctatgagctccgctacttcaacattgctgagaacgagggcgaggaagaa

SEQ ID NO: 80376 - DNA, 332 bp, Zea mays
  unsure at all n locations
  Clone ID: LIB3088-044-Q1-K1-H2
cgcttttgctctctccctcccggctctcggcttcttctacacgctaccgtaaacgccccggtcccggatcccgctagttcttcgccccagcatggccgcctcgtcgaccgccacctccgtccacgacttcatcgtcaaggatgcgagcggcaaagacgttgacctcagcgcctacaaggggaaggttcttctcattgttaacgtcgcatcccagtgtggcttaactaactccaactacactgagctggcccagctctacgagaagtacaaggatcaaggctntgaaatcctggctttcccatgcaaccagtttggtgggcaggagcctggta

SEQ ID NO: 80377 - DNA, 445 bp, Zea mays
  unsure at all n locations
  Clone ID: LIB3088-044-Q1-K1-H3
cccacgcgtccggctgcttctagtgtctgccccgttcgtcctttaagcagataatgacttgtgttaacaaaaatagatgcccctcacatttccttttttgtccccccacaacaacaccatgcatgattacttctcctgaacaatgcatgcacacctagggtaaaataaaatactctcacatccaccacccttaggctatggagtgtgttgattacattacaggcatgccagcatccgtgtttgcttgtgtgtgcagataacaggcgagacggttggggaggtgaaggccgtggcaggtatgcatcagaggaaagctgacatggccagtcaatctgacgccttcatagcacttcctggagggtatggaacccttgaggagctgctggaagtgatcacctgngcgcagcttggcattcacaacaagccggttggcctgctaaacgtg

SEQ ID NO: 80378 - DNA, 284 bp, Zea mays
  Clone ID: LIB3088-044-Q1-K1-H4
cccacgcgtccgcccacgcgtccgggtcggcggtcggcggccggttcccgagcacgtcatcgtcgatgggccacttcttcggcgcggcggcgggcagcgtgggcggggcggacgtgatgagcatccaggacgcggtgggcaacacgcgggcggacggcacgggcgcgctgctgcgcgagagcgccgccgcgctgctcaactccatgacccgcgccgggttcccctacaccacggagcaggtccgcgacgcgttcgcggcggcggcggcggccgggtccgacggc

SEQ ID NO: 80379 - DNA, 365 bp, Zea mays
  Clone ID: LIB3088-044-Q1-K1-G10
cccacgcgtccgcccacgcgtccgcttctttattagctcctactcctagtccgggtcgacgcatcatcgatcgagctgcacgttggttctggctgctctcctggtatgggtcccacgctgccgcggcgaggcttccggctcagttttattgtgtggtcggcggcgaggcacgcggcggccatgggatcccaccgcgacggcggtgtagaatgatagcagctgtaatacactactctgtactgtgatgtgcaagtagatagtactagttactagttagccagtgtagggttcctccgtgtaacaagtcatcagcgtgtgatcctcttcgtctgttcatcaatatacacatttctatatgtttcaac

SEQ ID NO: 80380 - DNA, 454 bp, Zea mays
  Clone ID: LIB3088-044-Q1-K1-A1
cccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggcctcgccacgccgcccgactgctagcagtgtgctagccaagccaagccaagcaggaaggcccccggcattgctagctgtacgtgtctgtgtgtgcatctgcagcagggtgcaggcaggggcccgtacgtacgtgtctctttctctctctcatcttgtcaccgtacctatctagagtgtgtgtgttcgtactaattaaaatgttcttgtcgtcgtcgtctgtgcatgcatgtaccatgtcgtcgtgcatgtctattatgtgtgtgtcgtcgtgtcgatcggtacgtatagatgcctggtgttagcatgtgt

SEQ ID NO: 80381 - DNA, 432 bp, Zea mays
  Clone ID: LIB3088-044-Q1-K1-A10
tcagggagctggagaagaaattttgcggcatggatgtggtaattgttgccacaaggaggagcgtgaggccgcccaagaagggttcagctgttcagcgccctcgcaccaggactctgactgctgtccatgatggcatcctggaggatgttgtcttcccagctgagattgtggggaagcgtgtcaggtaccgtctggatggtgccaagatcatcaagatcttcttggacccaaaggagaggaacaacaccgaatacaagctggacacctacactacggtctaccgcaggctgtgtgggaaagatgtggtctttgagtaccctatggccgaaaatgcataaatatgacgcccggatatccccattttattttgttgaatctggatgtttctttggggtctcaactagactgctccgtatgtacttcaaaaaccat

SEQ ID NO: 80382 - DNA, 317 bp, Zea mays
  Clone ID: LIB3088-044-Q1-K1-A12
aaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaataaaggtacctaaactatataagatttaaaaaaaaaatcattttgaaaacaacttaaaattatcataaaagggaccccataaatgtaatattaatctaaggtgtaaaaaaaaaaatacttaaatggaaa

SEQ ID NO: 80383 - DNA, 303 bp, Zea mays
  Clone ID: LIB3088-044-Q1-K1-A2
cgtcggtctgttcgaggacaccaacctctgcgccatccacgccaagcgcgtcaccatcatgcccaaagacatccagctcgcccgccgcatccgcggcgagcgcgcgtaggcgtatctcgcgcccggccccagtggcggcggagggatggaggagtgcaatttgtaactttatgctgtttgttcgcttttagacggcgtggcgaagtagtgtaaaaacggctttacaagtctattttgtgtggtagttcgtgtaccgcttcgtcccgaagcgatcttggtaaaagactgatgattcgtgttgcc

SEQ ID NO: 80384 - DNA, 438 bp, Zea mays
  Clone ID: LIB3088-044-Q1-K1-A3
ctcacgcgtccgatccgctgtcgcatgcgctgtatttcaagctctactccatgaagtgcagctccaagagcaacaccagcagggacgcgggcatggacggcaccgcagcaagagccaacaaggacgcgaacaagggcacggccggacgcacggccaacaagccgaggacgaagtccgtgacgaggtccctgaaggcccggctgcagcgcatcgtgcggcgtatgaagaaggatctgaacaaggaccgcgacgcgcagggcgtccgcacgtacgtggccgtctacctggacgacgtgctcgagtacgtggtcgaccaggtgctggaccttgccgacgacaatgacaaggacaacatgatgacgcgcatcatgctgctggacatgctcatggacaagcagctcgacgaggagctgggcaagctgatgatcggcgacagca

SEQ ID NO: 80385 - DNA, 123 bp, Zea mays
  Clone ID: LIB3088-044-Q1-K1-A4
cccacgcgtccgcccacgcgtccgcccacgcttccgcggtctcgtgggaaaaaaaataaaggaaaaaattagaaaaatttataacaaataatatataaatatatctcacttattttattgttt

SEQ ID NO: 80386 - DNA, 391 bp, Zea mays
  Clone ID: LIB3088-044-Q1-K1-A5
ctcacgcgtccgatcctctgtcgcatgcgctgtacttcaagctctacttcatgaactgcaggtccaagggcaacaccaccagggacgccggcatagacgccaccgcagcaagagccaacaagaacgcgaacaagggcacggccggccgcacggccaacaagtcgaggaagaagtccgtgacgaggtccctgaaggtccggctgcagctcatcgtgcggcatatgaagcagggtctgaacaaggaccgctacgcgcagggcgcccgcacgtacgtcgccgtctacctggactacctgctcgactacgtgctcgaccaggtcctggaccttgccaacgacaatgacaaggaccacatgatgacccgcaacatgctgctcgacatgctcatgga

SEQ ID NO: 80387 - DNA, 439 bp, Zea mays
  Clone ID: LIB3088-044-Q1-K1-A6
cccacgcgtccgggaaaaacaatggcaaaaggcagtaaatttgtacactgaagcaataaaggtaaatggaaaagtggctacatactacagcaacagagctgctgcctttctagaactaactagctaccgtcaggctgaggcagattgcacaagtgccatcgaacttgattccaagagcgtgaaagcttatttacggagaggcactgcaagggagatgctaggttattataaggaggccgttgatgatttcaaccacgcccttgttctagaaccaatgaacaagacggctggtgttgccatcaacaggttaaagaagctgtttccttgaatatgaagctgcatgaagatatgataacctcatattttgtgcacacacaagttgtgcgtgtcagtggggtgggattgaagtacctgagttcaaccgacggatgctgatcac

SEQ ID NO: 80388 - DNA, 356 bp, Zea mays
  Clone ID: LIB3088-044-Q1-K1-A7
ataatgtctctgatactgtctttcatccgttttactgctatcgctagtgcatcaagtctaggtggaacataataaaacacagggacgcgtacaaagtctgcaccacaagcagagtacaaacagaggctattaattgcgctgaaccaccaatggttgagacgtcaatgaataggtaaactattaacttgctcattttcgagctccttctcattgattgtattctatgtaaggactcgacgatggacgtcttgcacacacgaatccaatcattgtagttcgaaaacttgaaaacgtactcgaataagtggtcgaactggtcatgaaaattgccggccactctagcaggtccaacatta

SEQ ID NO: 80389 - DNA, 268 bp, Zea mays
  Clone ID: LIB3088-044-Q1-K1-A8
ggtcgacgatagatcagattcagagttgctttcactggttatcttgtgaagcggccaagcgtaattatttatgcgacataacctgtgctattgtaatgtgtcacatgcttatatttgcaataaacagctctaggtggtcagctttgtctgccgcaatgagcagtgtatcgatattgtggttttgaattgtttggatctagaaaaaaaaaaaaaaaaaaaacaaatagaaaaaaaataaaaacaagaaaaataataaaacaatgcatgg

SEQ ID NO: 80390 - DNA, 425 bp, Zea mays
  unsure at all n locations
  Clone ID: LIB3088-044-Q1-K1-A9
ggcaagactttgttggccaaggcaattgccaatgaatgccaagctaacttcattagtgtgaagggtcctgaactgcttaccatgtggtttggtgagagtgaggccaatgtccgtgagatttttgacaaggctaggcagtctgctccatgtgtcctcttttttgatgagctcgactccattgctactcagagaggaagcagtgttggtgacgccggtggtgctgctgatagggtgttgaaccagctgcttactgagatggatggcatgaatgccaagaagacggtttttattatcggtgcaactaacagaccggacatcattgacccagccttgctgaggcctgngcgtcttgatcagcttatctatattcctctgcccgatgagcagtccaggcttcagatcttcaaagcctgtctcaggaagtc

SEQ ID NO: 80391 - DNA, 316 bp, Zea mays
  Clone ID: LIB3088-044-Q1-K1-B1
aaattttttttttgactgccttttcccccctgccccgttatggttggcgcaacgaggctttgtggtccataataaaacacagcggagtgtagaaaatgtgcaccaggagcagtttacaaacagcggttcttttttgtgctgaaccaccagtagttgagccgtgaaggaatggaaaaactttccacttgctcatttccgagcgccttctcattcattgtatgcatgttttggactcgaggctggacgtcttgcacacaggaatccaatcactggagttgcaaaaaaaaaaaacataatcaattaaatggtcgaactg

SEQ ID NO: 80392 - DNA, 417 bp, Zea mays
  Clone ID: LIB3088-044-Q1-K1-B10
gccggcttctaatccgtactctttgtggcttcgcattcatggcgccctacgcggttaagaggcccgtttcgaacagagccacataggacgatcccattgccaataccgctccttccgcgaagaactccaatgcggcaaagcctatcacagcatgcaaatccgccttcacagactacggcaagggaatagaggtgccggtcgaaggtcaagaagagcagtgcagacctacaacatctacatcttcaaggcgctgtagcaggtgcacgcgaacatcaacatcttctataacgtcatgtgcatcatgaactacttgatcaacgacatcttccagaagctcgccgtcgaggccgtcaagctcacgcggtacaacaagaagctcaccatcacgtcccgtgagatccagatcttcctgcgcct

SEQ ID NO: 80393 - DNA, 415 bp, Zea mays
  Clone ID: LIB3088-044-Q1-K1-B11
cccacgcgtccgcccacgcgtccggtcagctcaagtgacgtgattagaccgaacatgtctgttcgcgaaggcattgaaattgttgtctctgtgggcacatcgatgcctcaagtattgtcgattctggaaactgagccaaaccagttgaacaggatcagatccacccgaagctgagatgacttcacattttgtaatttcgtgttacaaagtccttgttgtacaagagtaggttctgacagattgtacagttctcctgggtagaaagcaaaatctgtttgtgaacacatctcacctgaacgcgattgcttgtatggccgtctcagcttcttcagaaatgtaacttagcagttgagtagagttgacctatgttaagagttgtcaagttttgaagtggaagaattttcttaaccatttg

SEQ ID NO: 80394 - DNA, 423 bp, Zea mays
  Clone ID: LIB3088-044-Q1-K1-B12
acccgagcttatgatgcagggggtctcgggcttctatgcgacgatcatgctcaaatgtctgcctgcgggcatggcgggcccgatcactgctcttccggacctcccgaccatccacacgacgatcgacaagaccaagcgcgcccattggcacacggcacatacggacgcctgacgcacgcactgtgcacacgagatcggactttgagcgagacctacataggccactgtatgacaatcctgccatggcgtaagcagatgcgtagctgtaatctgtataagaagacactatgtatgagctcctgcggaaccctagaaagtgcatagctgtgaccaaactggactctcacgggctgaagaagccggcggaccgtgctgatgatacaaggttactgacggatgcatgcgactagatcattgacatgc

SEQ ID NO: 80395 - DNA, 371 bp, Zea mays
  Clone ID: LIB3088-044-Q1-K1-B2
acgcggacgcgtgtgctgcaacggatatctcggttctcgcatcgatgaataacgtggcaaaatgcgatacctggtgtgaattgcagaatcccgcgaaccatcgagtttttgaacgcaagttgcgcccgaagccttctggcggaaggcacgtctgcctgggcgtcacgccaaaagacatagaagaaaaaaaatgaaagaatctaaaaaaaaaaaaaatataaaaaaatataaaaaaaaaaataaaaaataaaaaataaatattaaatattaaaaaagggcgtcctttcgtgacttaaaattaaccgtcccaattaacgtccccgtccattaaacctacaaaatcccgtgttccctcgtcttaatcaatttaa

SEQ ID NO: 80396 - DNA, 277 bp, Zea mays
  Clone ID: LIB3088-043-Q1-K1-H9
cccacgcgtccgcccacgcgtccgatccctccccccccattcaatagatcgtagtgaggagagtgattacagcgagcagaaatagtcggcatttaaaataattcgtggctttcgagtttgtaacagcgtgcgggttcaatcctgcccgtaattttcctttgtaataataacatgagcaaaatcttgacagccggcagcgaatgtcgctctggagatggcaaatgtgtgttttgaactgaatggtaaatgtgcggttctcttgaatagtatcttggct

SEQ ID NO: 80397 - DNA, 383 bp, Zea mays
  unsure at all n locations
  Clone ID: LIB3088-043-Q1-K1-G10
gaagctagaggaaactataaaaaatatacatgaagagatgctttatctgcgtgaaagggagtaggaaatgcaggacgtgaacaggcnaacgaactcaaggatggcttggctagggttcctctcccttggcgtctgcttatcagtggcaggtttgcagctgtggcacctgaagaccttctttgaaaggaagaagttgttgtagactgtagttggcccatggttcacggtagacctcagcgcaggtgtaacctatttttgggtgaactgccgatctgttacggagcttgaaatcccatgtaacaaacgttatgtcgtacttgagaaaatatgctttagcctgtccagttgaaattataagaaacttgaaatagatactaaattgt

SEQ ID NO: 80398 - DNA, 355 bp, Zea mays
  unsure at all n locations
  Clone ID: LIB3088-043-Q1-K1-G11
gcgtgcgccacgtcgctggagtccatggtggacttcgccaccgacagcctcgggaccaggcgcgtgagggccgtgtcgaccgtcgtggctaatgagggatcgccgaagcatgagtacacggtgaccggcgtggagcgcgctgtcggcggcaccgacgacgacggccgggccgtggcctgccacgcggagccgtacgcgtacgccgtgttcgcgtgccacctgacgcggcagacgcgggcgtactcggtgtcgatgctcggcagggacggcacggacgtggacgctgtcgcggtgtgccacgccgacacgtncggctggaaccccaagcacgtcgccttacaaatgctcaacgtga

SEQ ID NO: 80399 - DNA, 389 bp, Zea mays
  unsure at all n locations
  Clone ID: LIB3088-043-Q1-K1-G12
cccaaatccagttccgttccaatcgccgagaagggcagcaaaggggagaaaaaaaaggaagacgatggcggcggccggcggcgagaacagcggcgcgggcgagggcgagggcgagttttacctgcgctactacgtgggtcacaagggcaagttcgggcacgagttcctcgagttcgagttccgccccgacggcaagctccgctacgccaacaactccaactacaagaacgacaccatgatccgcaaggaggtcttcgtctcgccctccgtcctccgcgaggccaggaggatcatccaggagtccgacatcatgaaggaggacgacagcaactggcccgagcccgaccgcatcggccgncaggagctcgagatcgtcattgggcacgagc

SEQ ID NO: 80400 - DNA, 354 bp, Zea mays
  Clone ID: LIB3088-043-Q1-K1-G4
gagccatcatgtcttttgttcgaaatggccctgctggaatgtgggggatctcctcccagtttgggcgatattttgaaacttcttcagtgccgtgttttttcggatccatatgcttagaacagaacaaatatcaaggagtacggacaagaagaaatttttagctcttcttggcttcgaggtccttgtggttgctttctcctccgttctctggtttatgttcaaagatggctacgttgataccagcggatccagctttgaatcttggacgttcgggatgctctgggataccacagtttcgtttccttggataccagcattgtacactggggttctttctacggtgttatgcatgtg

SEQ ID NO: 80401 - DNA, 397 bp, Zea mays
  Clone ID: LIB3088-043-Q1-K1-G5
cggacgcgtgggggaacccgatactcgtgttaactgtatagcccctggttttgttcctacgcggggggctagtttcctcacagaaaatgagaccattaggaaagagcttaacgagaggaccaagcttaagagattgggtactgtggaagacatggctgcggctgcggctttcctggcatctgacgacgcatcatacattacggctgaaaccattgttgttgctggaggggtgcagtctaggctgtaaatctggctgaagtttatatttacttggttaataatgtgtactagtgccctaggcgtggctaataatgtgtactagtgccgctagagcatcaggctaccttctatatatgacaggcaactctaaaagattttctatatcttattcctcttc

SEQ ID NO: 80402 - DNA, 388 bp, Zea mays
  unsure at all n locations
  Clone ID: LIB3088-043-Q1-K1-G6
gaagctagaggaaactataaaaaatatacatgaagagatgctttatctgcgtgaaagggaagaggaaatgcatgacgtgaacaggcgaacgaactcaaggatggcttggctagggttcctctcccttggcgtctgcttatcagtggcaggtttgcagctgtggcacctgaagaccttctttgaaaggaagaagttgttgtagactgtagttggcccatggttcacggtagacctcagcgcaggtgtaacctatttttgggtgaactgccgatctgttacggagcttgaaatcccatgtaacaaacgttatgtcgtacttgagaaaatatgctttagcctgtccagttgaaatttatagaaaacttgaatagatactanattgtcttcc

SEQ ID NO: 80403 - DNA, 320 bp, Zea mays
  Clone ID: LIB3088-043-Q1-K1-G7
ggagaagttggggtctcagttggagattcttgcccctatcaagtactgaggagctgtgctgtgtcatcagttttggggaacatctagtctttgttttaagtgttcggtaacagtttgtgacagtataatctggtaaaccgtgttatttttctgccactcctatttgaacacattttctagctggtgaatgaactgtttggtcgatcttgttcagatgtctggttcgcattcgcattctgagagatttcatgtctcgtgctgactcaagctgtcacgcccatgtgcttcttgcacacgattatcaattcagtagttgtgat

SEQ ID NO: 80404 - DNA, 341 bp, Zea mays
  Clone ID: LIB3088-043-Q1-K1-G8
ccaagctgaagctcgacaaggaccgtaaggcgctcctcgaccgcaaggcccggggccgcgccgccgacaaggctaagggcaagtttactgccgatgacgtcgctgccgccgccgctggtggcgccgccaccggcgcctctctccaggagatcgactagactcttcacggtcatctgatggttgtcgtaccgccttttcctcatctctttagtttttgctaccaattgttatgtgatagaggtcttatgttatttgaaaactgctctgtgcctggatgagagttttggaacataatgtgaacctgtgtgtctgtgacctgagctttgaagatctcattatgt

SEQ ID NO: 80405 - DNA, 95 bp, Zea mays
  Clone ID: LIB3088-043-Q1-K1-G9
tgaaaaaaaaaaaaaaaaaaaaaaaaaaaaaaaaaaaaaaaaaaaaaaaaaaaaaaggggggggcggataaaaccaaaaaaaaaaacatacgggc

SEQ ID NO: 80406 - DNA, 379 bp, Zea mays
  unsure at all n locations
  Clone ID: LIB3088-043-Q1-K1-H1
atagactgtgaacaagcgagagaagcaaagaccagaaagtattgtgctgagtgcgtgctaagccacatgcccagatacttgaggcaacttgattccaaatacgacttttagtaacctattgtgtcgtataattccgttattctctgctagacctagtaatggggaacaactatctccaaaagtaacatttggttaggtgaccaatgatgctttcagataactgcaacgtctgatgtcatctaagttcgctcagtatatatatgacaaaagtgcatcagatttttctcactcaattcttcttcctagtttggtagacaaaagttgagcattagaaagcataaatttctcaggagaagcttgcagacagacanctgttttg

SEQ ID NO: 80407 - DNA, 367 bp, Zea mays
  Clone ID: LIB3088-043-Q1-K1-H10
ccctagcaaattgatcgtgggagctgatttccattgcttcaagaacaagatcgagccaaggtgggaagaccctatttgtgcgaatggtggtaaatggaccatcagctgtggaagaggaaaatctgatacattttggctgcacactctgctggctatgattggtgaacaattcgactatggtgatgaaatttgtggcgcagttgtcagtgtgcgtgggaagcaagaaagaattgctatctggacaaaaaatgctgccaatgaagctgctcaggtaagcatcgggaagcagtggaaggaacttctggactacaaggactccattggattcattgttcatgacgatgcaaagaagatggacaaaggcctg

SEQ ID NO: 80408 - DNA, 419 bp, Zea mays
  unsure at all n locations
  Clone ID: LIB3088-043-Q1-K1-H11
atcgtttgatggtgacatgcaaattgcactttctctccgcaccatcgtattctcgacagcgccgagccacaacacgatgtactcatacaaagacgcagataggcgtcgggagtgggtcgctcatcttcaggctggtgcaggcattgttgccgacagtagcccagatgacgaacaacgtgaatgcgagaataaggctgctgcactagctcgggccatcgatcttgcagagtcagcctttgtagacaaagaatagtgtgctatggttatcgtttagttcttgttcatgtttcttttacccactttccgttaaaaaaagatgtcattagtgggtggagaaaagcaataagactgttctctagagaaaccgaagaaatatggnnaatgaggttatggcttatgacttgtcgttgttcagtatg

SEQ ID NO: 80409 - DNA, 320 bp, Zea mays
  Clone ID: LIB3088-043-Q1-K1-H12
ggtcgacgccacgccgttcgcccaaatcgaccgagccgaattcaccacagtcttctcaccaccgctaccttcgatggcacccagggcggacaagaagccggcggcgaataagcctgcagaggaggagcccgcgacagagaaggcggagaaggctccggcggggaagaagcccaaggccgagaagcgcctcccggcgggcaagtccgcccgtaaggagggcggcgagggcaataaggggaaaaagatagcgaagaagtccgtggagacctacaagatctacatctttaaggtgctgaagcaggtgcaccccgacatcggca

SEQ ID NO: 80410 - DNA, 397 bp, Zea mays
  Clone ID: LIB3088-043-Q1-K1-H2
cccacgcgtccgagaggattgagaatgacgagactgggcacaaacactgtaccggccagtgctttgattactggaaatgtgttgacaagaatgttgcaaaaaaactctttgagatgttaaaatgacaagaaaagttttccctacttcagttatccacccaaagttggtaataattgtatcacttgtgtggcctatagactattaaggcgctcaatatttgttagagaagttttgccacttgggtaacacaaattttccactgccagtttgcatttcatttctgctactagtattgaaccagcaggtttcctcctgcattgttggataaaaaatccatcgaatatttacaagattgtggctgattattaaatgctgtaatacaccttaattggctttt

SEQ ID NO: 80411 - DNA, 310 bp, Zea mays
  unsure at all n locations
  Clone ID: LIB3088-043-Q1-K1-H3
cccacgcgtncgctgcattcagcaaagcatgagtatgcatcaaaagcagatgtccatgaacgcagagatatttgttgatcatgatgtatacctgccacctgccccaagccatcatgatgctcatggccagttttgctctggaggtattgtattggcttctcgagatggaaagattgtgtttgagagtacacttgacgcaagactagaagttgttttccgcaagaaattgccagagatccggaagcttctttttggccagactgcagcctaatcgactcatctgccgatggtacgactgcttctatgtaat

SEQ ID NO: 80412 - DNA, 315 bp, Zea mays
  Clone ID: LIB3088-043-Q1-K1-H4
aaagactaaaagaacagaataatttattaaacctaatccaacttatatacaatactcgtagttgatattcaaacatttgatgtgacacgaactaaacttaagtcaggggaaccatgtgagccattaatactgggtttaacttctttttatctccaggtttactctccttggcctaatccatttttcaggatttttgatggaagaaattcatgtgagcatatgcatgcacacataaacctgtgttgtttcagcctttcaggatacagcatggtgagcaggaccagttgggcacgtgctccatcgactgcgggtgca

SEQ ID NO: 80413 - DNA, 76 bp, Zea mays
  unsure at all n locations
  Clone ID: LIB3088-043-Q1-K1-H6
nnaataaaatatttaannaaaaaaaaaaaaaaaaaatttaaaaaaannnnnnnnnnnnntgggggngggttnattt

SEQ ID NO: 80414 - DNA, 173 bp, Zea mays
  Clone ID: LIB3088-043-Q1-K1-H7
cccacgcgtccgcccacgcgtccgcggacgcgtggggtactgttcacgctgacttgtacttgctcgtgcgtcacgcttgtacttttatcttctgtcaaaccaaaggtacatttgtaattcaatattgtttatatttttccatgataatataatgaggataaattgacagtgct

SEQ ID NO: 80415 - DNA, 342 bp, Zea mays
  unsure at all n locations
  Clone ID: LIB3088-043-Q1-K1-G1
cccacgcgtccgcccacgcgtncgcggacgcgtgggcgaggggaagcatggcggcaagctgcccaccaacttccgcaagcagctcactgtgcagctgaagaagctcgctgccgccggcaagctgacgagggtgaagaactccttcaagctgccggccaccgacgccaagcccaaggccgccaagcccaaggcacccaaggccgcgcccaagcccaagccctcgccgaaggcgaaggccaagaccgctgcgaagcccaaggcggcgtcgcccaaacccaaggccaaggccaaggccaagcctgtcgctcctgccgccgcgtcgcccaagccccgcgggcgccc

SEQ ID NO: 80416 - DNA, 310 bp, Zea mays
  Clone ID: LIB3088-043-Q1-K1-H8
cacgtccgtggatggagacctcaataagaaagtggacgccaagaactcgctggagaactgcggctacaacatgcgctacacgatcaaggactagaagattgcgtacaagctgacggtcgatgactagaagaagatcgaggacgccatctacgcggtcatcagctggctggacgccaaccagctcgacgaggcagacgagttctatgacatgatgaaggatctggagagtctctgctaccctatgattgtcaagatgtacctatgcgctggtcaagacatgggcggcgctggcggtatggacgacgacgcc

SEQ ID NO: 80417 - DNA, 432 bp, Zea mays
  unsure at all n locations
  Clone ID: LIB3088-043-Q1-K1-E5
catcgtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtcggcgccgacgaccggcggcgtgaagaagccccacaggtacaggcccggcaccgtggcgctgcgcgagatccgcangtaccagaagagcacggagctgctcatccggaagttgcccttccagcgcctggtccgtgagatcgctcaggacttcaagacggatctgcggttccagagccacgccgtcctggccctccaggaagccgccgaggcctacctcgtcggtctgttcgaggacaccaacctctgcgccatccacgccaagcgcgtcaccatcatgccc

SEQ ID NO: 80418 - DNA, 429 bp, Zea mays
  Clone ID: LIB3088-043-Q1-K1-E6
cggacgcgtgggttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaaggttcacatcaaaccttgagagccagaggaagcatgtcaccatttgtgctttagcaatgttttcgaaaagattatgatctgtatcttg

SEQ ID NO: 80419 - DNA, 458 bp, Zea mays
  unsure at all n locations
  Clone ID: LIB3088-043-Q1-K1-E7
ggttcaccgccgagcaggtcctcgctcacccgtggatcgtgagcggcggcggagcgcgtggcatggagcggccaacctgaggcggcgcgcggcataccataccagcagaccatggcgggcggacgtgtattgccgtagagacacagattcggcaaggaatcccgacgttatgtgcagaggttttgttatgtgcgtacggaccagagaaggagagacggtagctgctgccggctgcagagtagcaagcatcctttgcggtgtactgtagtcgcagactcggtagcagagcagatggatcggcaagaagcttctggtaggcaggcttttggttttcctcaggcccccgggagatgctctttacctatgagcaccctntttggacgtgctggtagctggatgtgtatatacactgaccgtcnttgtacaaaccgagagggtttgataataaataaataaat

SEQ ID NO: 80420 - DNA, 404 bp, Zea mays
  Clone ID: LIB3088-043-Q1-K1-E8
cccacgcgtccgtggattttctgggtgggcccgctcctgggcgctgccatcgcgggcttggaccaccagtacatcctccgggcgggcgccatcaaggctctcggctccttcaggagcaacgcgtgatgagcagagctaaagaaaggccttcgctggactgcgtgctggagcaacggcgatcgatcgatctagcgtggggagaggcggataggcgggcgcgcgagggaggagaataagtttgtgccggtggcccggtctcgtcggtcgcttttgttccagcatgcagctgcgtcgcgttcgtgtgcgtgcgtgggggtctccttaatttccccggcccctgtaatcatcaatcaccatgtgtgcgtataatatctgctgccaaaggatcgattattccccccccc

SEQ ID NO: 80421 - DNA, 245 bp, Zea mays
  unsure at all n locations
  Clone ID: LIB3088-043-Q1-K1-E9
cggacgcgtgggtggcgatcaagaatccgaagctgtcggcgatgcggtgccatgaaagggtgtttgcaaatatgtacaaaacataataacatgtgtaggttttgtgaatgattttgttgtggtgcttattgatggtttatgtgatgtggatcanaaaaaaaaaaaaaaaaaaaaaaaaaaaaaaaaaaaaaaaaaaaaaaaaaaaaaaaaaaaaaaaaaaaaaaaggggggaaaaataaaaagat

SEQ ID NO: 80422 - DNA, 427 bp, Zea mays
  unsure at all n locations
  Clone ID: LIB3088-043-Q1-K1-F1
gccccaggtgcctctgcgctgtcatgctgtccaacaccgccaggagcgccgggatcaaggccgaggtcgccatcaccatccncaaacgctgcaacctcgccgaccgccccgttggctacaagtgcggagattacaccctgccatgagcggcggtgagttctccaggtcggatttgctgcatggcatgcccgagtatcaccaaagcgcgagctcttgtgtcgagcgagtccgtgtctgtcgtcagtcagtctctatgtgttgcccatagtaaacaaagacatgcgagtaccagacatgtgcaactctagtagcatggtgcgtgtatcactaggtacgcgtactcgtatcgttgtgttcagttctgggtctatagagatgtagccctgcattgtcgaaataaatactgtgtncactcgttcgtgaaatg

SEQ ID NO: 80423 - DNA, 470 bp, Zea mays
  unsure at all n locations
  Clone ID: LIB3088-043-Q1-K1-F10
cccacgcgtccgcccacgcgtccgcccacgcgtccggggttacatatacttcactttataggttgaaacagtgggagcaccttgattggattgctcgtaccactacttttatcttgtagttcatgccaaccagctcgctcaagccaagtgttgaccggaaatgcgtataggttctggattattatttttagtgtatataggatggtgattgttcagcaaagtttgctcaagtaaaaaaaaaaggtgatcctcattcctcctctgtttttattgtgattattatttttagtgtatataggatggtgattgaacagcttgcaaccttgcacttgcagcatattccatccactggaaataattttcctgcagtaatctgcatagcgcaatccttgagtaatctgatcgatataagagcagcatgtagtacctggacctgatcttcttcttttanggaaaaaaaacaaactaca

SEQ ID NO: 80424 - DNA, 301 bp, Zea mays
  unsure at all n locations
  Clone ID: LIB3088-043-Q1-K1-F11
ccacgcgtccgcccacgcgtccgctccactcatcttttcgcgtttagaacctcggaaatgtcccccactcgccagtcgcagcagcacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgncgtcctggagta

SEQ ID NO: 80425 - DNA, 446 bp, Zea mays
  unsure at all n locations
  Clone ID: LIB3088-043-Q1-K1-F12
acaaagttgtggcaactgagacagcaaaggcgtttgctgatgagatgggcatccgattcatggagacgagtgccaaaaacgccatcaacgtggagcaggccttcatggctatggctgcatccatcaaggataggatggccagccaaccagccgcggccaacgcaaggccagcgaccgtgcagatccgcgggcaacccgtcaaccagaagacgtcttgctgctcgtcctaagattgcctcatttccttggttccttgtgactatttctacggtttgtgcgcgcacgcaaatgtatttgcattattcctgatagcatctattcgttggccagatgattagagagctgaaaatatattaagaacaataccatagagagaagttcctcagtgctctcgcagcttaaggagcaaacagcaacactntaccttcgtttttatactttattat

SEQ ID NO: 80426 - DNA, 413 bp, Zea mays
  unsure at all n locations
  Clone ID: LIB3088-043-Q1-K1-F2
gtagtgccatggcacacagggctgttgatgctgtattaggtccccggaccattcagcatgagactgttgcctcagaagctgctgctgctgcccctgcccctccagtgatgaatgctgacgcttgcagcatccattctaaggctttccaagattgtctcaacaactatggcagcgagatcagcaagtgccagttctacctagacatgctgaacgagtgccgccgtggtggtgtgtctgcctaagctgcttctggggttattcgtggattttctttcggtgatgctatctcattaataagataccgtgaaacttttgtctccacagcttgaagctaaacttcctgggattaatacattttgttatcctatgctgttggagcagacttttgtctctttgatcataaatattanacg

SEQ ID NO: 80427 - DNA, 452 bp, Zea mays
  unsure at all n locations
  Clone ID: LIB3088-043-Q1-K1-F3
tcctctccctggctccacgacgcggcggcctgctagctctctgggcgggctactaattcggcggatggtgtcgactgctacttctccgatgccgcgcgcgcggcccgtgcggtccgctgcgcctccgtcggatgcgcaagcaggaggcggacgcgcggcccgctgtgcctccttgcgcccccatcgcccgaggcagaccgtcgtgctcgcctgctccatccggtcccgtcgtcgaagagtcctcttcgccggcgtcgcgcccgtctctgtgtttcccatgtcgtggcggcgtgctcctctgcgccggcgccgcacaacctcatgtcagctttcgtcgctgcgatgcccacggccggcggtngtgctcctcctactncacgcccacctttcgccgaccttcagctgcgcgtcgtgatgcagcgagactcgagcttgcgtgtcctgtacgcgtc

SEQ ID NO: 80428 - DNA, 417 bp, Zea mays
  unsure at all n locations
  Clone ID: LIB3088-043-Q1-K1-F4
caggcaagtcccgccgccaaggaggccgccaggggaaagagggcccggagaaaggccagaagaggggggagacctacaagaactacatcttcaaagtgcttaaacaggggcacccggacatcggcatctcctctaagccatgtccatcatgaactccttcatcaacgacatcttcgagaagctcgccgccgaggccgccaagctcgcgcggtacaacaagaagcccaccatcacctcccgtgagatccagacctccgtgcgcctcgtcctccccggngagctcgccaagcacgccgtcttcgagggcaccaaggccgtcaccaagttcacctcgtcctaagctgcgtggcctccgcttgcaggcttccctcgtatgttcgcgtgtcttgctgtagttaggtgctgctgtgtctggtc

SEQ ID NO: 80429 - DNA, 418 bp, Zea mays
  Clone ID: LIB3088-043-Q1-K1-F6
ctggtgagaagcccgagccagtcaagacacatcttcgtaacatgatcattgtccctgagatgatgggaagcattgttggggtctacaacggcaagaccttcaaccaggttgagatcaagcctgagatgatcggccactaccttgctgagttttccatctcctacaagccggtcaagcacggcaggcccggtatcggtgccacccactcctctcgttttattcctctgaaatgagctgttacccggctttgtagtctcccaagagttcggtggcgatgttcattcagctcttctacttgttttgaacaagttaaatgcccaagacattttgttctgttccattccagctcaagaattcaaagctaagcattgcacactttatgcttgtttgtggaagtatttgagttaatcatatctaa

SEQ ID NO: 80430 - DNA, 379 bp, Zea mays
  Clone ID: LIB3088-043-Q1-K1-F8
ctcctgagcactttctcctcgtcccagacaagccaatcgaagccgagatacgaccatgggctccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccgcgccacgtgcttctggcgatccggaacgacgaggagcttggg

SEQ ID NO: 80431 - DNA, 407 bp, Zea mays
  Clone ID: LIB3088-043-Q1-K1-F9
cccacgcgtccgcagcctgatattttgcggtcattatattctgcactccaaccatgtaatactttggaagatcgaagatatcatgatgcccgtctttctgatcagcagatggcgttacttcagtaccaaagagagaatatccattatctgagtgaggaggttctccgcttgcaagaatgcttaagcaaataccagagaactgctggaaccactcctcaggttgatcttgcccatcttttagcaactcgtgatcaagaactccgagcactcactgctgagatgaatcaagtgcactccgaacttcaacatgcccgtggtttgatcgatgaaaaggattcagagctccagcgtatccgtctgagcaacaaccagtatgttgaagaaaacgataggctcagagctattct

SEQ ID NO: 80432 - DNA, 418 bp, Zea mays
  Clone ID: LIB3088-043-Q1-K1-E3
gaaagtatagcgaaagaatttgggataaaaagatataactggcttgtttacatggataaaggaaacaaagaacaggagaagaggcagaaagaaattgttaaaggcgacccatctataaaaaaaatgagccgtagagaaagaaggaaggcttctcagattgagcgggaaaaggagcgggaggcagcacgttctgttggaagggtatcttatcgtgatccttatagggaacaaaggagaagcccatcatatgaagcatattcaaggggcagaagatcaagatcgagatcaagatctcgttcaccatcccattctaggcgtcatggccgtgggatacatgctgaaagcaattattggagcaagcaaaaggctcctagggttgaatatattacttgaattggagggtccgatgataccagtg

SEQ ID NO: 80433 - DNA, 347 bp, Zea mays
  unsure at all n locations
  Clone ID: LIB3088-021-Q1-K1-C10
gtgtttgtttgcagctgcagctggatgaaaatggcagccgaaaatggcagccaaagcagtctcaagcgaatcgaaccgccggacttcgcagtcctcctccactaccagagcatgcgcgttgccgcgacccgagccgccgccgccgctcaccctccgagcgccttcctgctcctcctcgtactcctctgttgcgcgtccctcgcgatcggaggagcagccatggccggccacgtcctcggcggcgtgaaggagaacccagccgcggccaacagcgccgagtccgacgggctcggccgcttcgccgtcnacgagcacaacaggcccgagaacgcgctgctggagttcgt

SEQ ID NO: 80434 - DNA, 377 bp, Zea mays
  Clone ID: LIB3088-021-Q1-K1-C11
ggcgacatgactcgcggcaaccagcgtgaccgcgaccgtgagcgcgcggcggcgcgggagcccaacggcaagaactcccaggacgggctcaccccggagcagcgccgcgagagggacaagaaagctctggaggagaaggcggccaagaaggcgcagcaggcagcggccggcggcaccgggacctccacggacaacaacaagaacaaggcaggtggcaagaagtaggaggcagtggcgcgccgtcacctctgtacgattaatcgatgccttgagcttgtaacttgttcgcatccttgtaggtgcgatgcttgttgggtcataaactctgatgatatcgagatttggtgatgagaataatgcgtgggtttctggctaag

SEQ ID NO: 80435 - DNA, 380 bp, Zea mays
  Clone ID: LIB3088-021-Q1-K1-C3
gcggacgagcatcaaagcacacagtatttggttcgcggtttcctcttcgtcccgcaaggtcggcccacggagatccggccacggcgcacgttccccttttccgccgcagcgatggtgtacgtggattcctgggacgagttcgtggagcggtccgtgcagctcttccgcgccgaccccaacaccacccgctacgtgatgaagtatcggcactgccaggggaagctcgtgctcaaggtcactgatgaccgcgagtgcttgaaattcaagacagatcaagctcaggacgcatagaagatggagaagctcaacaacatcttttttgctctgatgactcgtgggcctgatgctgatatcagtgaaatttcagagaagggacaggc

SEQ ID NO: 80436 - DNA, 448 bp, Zea mays
  Clone ID: LIB3088-021-Q1-K1-C4
gcgattcggtgtgagaatcatgtgaattcagagacacatcatgaggaaatgtatgactacacacatattgctggttgggctggactccaccatggtcgacacaggcatggtgctcgagctacttcatctggtctcagaataaatctgcttttgtggtgccggagctctgtgttcagagagatgaagaaataccagaaggattttccgagctggtgtggtgaatgccagcgcgaaaagagggaaaggcagagtcagtgtgttaaagcaacgaagatggcctttctcaggggttctggaggtgcagcgatttaatttgtacgtaggtcatttatgttatatactgttttgcgtcatactgaacttcatcgtttaggacttgacaggggcattgtatcgatggccagctttgtgctaatgcgtttattggtgcgatcccaagtgtatgtaa

SEQ ID NO: 80437 - DNA, 380 bp, Zea mays
  Clone ID: LIB3088-021-Q1-K1-C5
cccacgcgtccggtctgccatgtgctctgctgcccagtcagtggtttctcctaaacaaagccagcacatttgggatcatttggctatgtttttccgagatgaactgttatcttggtcgtggaggcggcctctgggcattccatcagtccctgtcgcttctggaatgatcaacccatcagatttccaacagaaggtggtaaacaatgtggagcatgtcatcagtcgtatcaagtcaatatcgccacattgtctggctgaggaggaggagaatgcaaccgagccacctcagtcggtacaaagaggcgtcaccgagctggtggaagcggcattgtcgtccaggaacctgtgcatgatggatccgacgtggcacccatggttct

SEQ ID NO: 80438 - DNA, 442 bp, Zea mays
  Clone ID: LIB3088-021-Q1-K1-C6
gtcgaagcggtaagactgaagggaggccagacgcccaaggcactgaagcaatgcatgatatgacacccatctggtcctagtatcgccgtcaccgctggcgctgggtggaggtggaattggaaggaaggaacctcaagaagatgcacggcgcggcggtcttcgtggtgcagaccggcagtgcagtgcagggggctcgctcatccgcgcccaagttttggctcgagaagctgtgcataccgatcgccgcgtctgtccgtccactccctctgcgtctgtgaatgcgtgccagagtgaacgtgtagtgtcatcctgtacatacgtatggaacacaacattcgtgcttcggccttctgcagccaatgcgatccaggatgagccgtgtgccatgtgcttgcgttgcctcgtcggcccggaattgtgaatatgcctgtcacgtgcgggc

SEQ ID NO: 80439 - DNA, 438 bp, Zea mays
  unsure at all n locations
  Clone ID: LIB3088-021-Q1-K1-C7
atgggatggcctacacttcactgaggcgagttacaaagttgtcattcaaggagtactaggggggtatgccaagcctcccctttcagaaacctgcaagggtgcggaattcaaagtttctcagcttcaccaatgtacagataatccaacaaacactgtatcatacgatgctttgagctcttttatttgatctgctcgtaaaagaagtgcatttagagttacagtgggcagcatagatgatgttgcaggaccgaacatcttggacactttctcaaagccgagaagagatccatcgatgtagggtcattcagttctacaatccacttcgctgctgggaggatgagaaaaatgggaagngagtttgtagtgctgaaatttgcgattgcttagtgcactactttgctctgctatgttttccttagcagcttactactgcaggct

SEQ ID NO: 80440 - DNA, 334 bp, Zea mays
  Clone ID: LIB3088-021-Q1-K1-C8
ctgacacgtgctagaatgcaatggcctctttaacgaacaggaacatggatgctcaccatggagaggttgaccgggttatggctactatgcaaccaaagcatctgttctctgagaaactcacttttagaaagacacgcatgctataagctaaactccttactgcatctcttaataaaggactattgcactggttgttagatcaattgcatgaaacggtactgtgttcagtgttcatcctgcacttatacatgctactatgtacaatatttgacttgatatatctgatcctcttgatatatagcattaatgtctacatttcattaatgtgacaaag

SEQ ID NO: 80441 - DNA, 151 bp, Zea mays
  unsure at all n locations
  Clone ID: LIB3088-021-Q1-K1-C9
gccacgcgnccggccacgcgnccgcgggagcgaagcaacagccaacagggaccaaagggggagaaggggagccagcgccgcgccccgagaggcccacggaagccagcagaagcgcgcacaaaaccgaccgaaggcaagaccgccgggccag

SEQ ID NO: 80442 - DNA, 445 bp, Zea mays
  Clone ID: LIB3088-021-Q1-K1-D12
cctcctcaacctccagcccaacctccagcccggaatcgagagcaatggcgctcgccaaggccaaggagatcggtgcctccgctcccctcgtcgtcttcagcaaaacttcctgccctttctgcgtccgtgtgaagcagttgttcgagaagctcggagcaagctacaaggccattgagttggataaggaaagtgatggagctgagctccagaatgccctgaaggagtggactggacagaggactgtcccaaatgtcttcatcaatgggaagcatattggcggctgtgatgatactatggcactgaacaatgatgggaagcctgggcctctgctgactgaggctggagccatcgccggttctgcctcgaagacaaccatcactgcttgacatgtgtgttaccattcccgtgcttaaaaataatgatgctttgcaagtgctgaacttgc

SEQ ID NO: 80443 - DNA, 340 bp, Zea mays
  unsure at all n locations
  Clone ID: LIB3088-021-Q1-K1-D4
cccacgcgtccggccagtccggaaggacgagcgtcttcctgtgggggggaatgccttgtgtgcccacgcctaggttctctgctgaatcttccatctctcttcccttcaagactgctcactgctgcactgctctgttatctgaacccagaactttgtgtactcctgtaccgagctgtgtgtatgtttttttttttcttccatcgtgtttgttgcaagggttcccgtatccttttatgcgttgngatcgtggcangaaaaggcagatatcatgtggaaaccgtgggttatctatcagcttggattttcaatccaaggtggacccgattcaagattttttctc

SEQ ID NO: 80444 - DNA, 438 bp, Zea mays
  Clone ID: LIB3088-021-Q1-K1-D8
cggacgcgtgggctcccacggaaccaaactggaggggcacacatatgcacacagtttcgtctggtgatccaatgattccctaacctgcagtgctgtttgtcctcggcaaatttctgaactaaatcagcatgcaaacgcctggatgatgtggctccagctggataacctgctcatttttagccaggtttctgctttctcaatcgtgggcaagcggtttgtagaaatccaccagagtttctagttgtaaaatagtattccacgtactttaacaaaggtcccatgtactaagggctcatcatcagacacggtgacagtttttttctggagaaattgcaccttgcggctggctgcccaggttggtagagcaaattgcggccttctcttgtggcagttccccgtccgctaacatttgatcagggaaagggaaataagatggtg

SEQ ID NO: 80445 - DNA, 190 bp, Zea mays
  unsure at all n locations
  Clone ID: LIB3088-021-Q1-K1-D9
ccggggcgacgcacgcgaccgngcccaaccaagcagcaanaaagccgctggcacagcatgcggcaacaagctnggcacagggctgaaaggggggagcgnaaggcgagaaagaagagcgactggacagggagagcatnaacggancgactaaactttctgaagagtatataaacattatactcacctgtac

SEQ ID NO: 80446 - DNA, 369 bp, Zea mays
  Clone ID: LIB3088-021-Q1-K1-E1
gcgcccacgcgtccgggaaagcactattctcagacatcttgaaactaatggaacagggctacgcgtacgtgccgtgaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgaagtccaacccgtcgggtggttatggcgagctgacccattttttttttgtatggaaaatcatcagctgtgacaaaaggcatatgttgcatgcactagttgaagaaactggtccaattgcttttttggtcaaaaaaaaaaaaatttataattataatttatttt

SEQ ID NO: 80447 - DNA, 258 bp, Zea mays
  Clone ID: LIB3088-021-Q1-K1-E10
cggaaagaagcagccacgcagaacgacgaagctagcttcgactcaaatcaggcaaaggggaggactagatagaccttggcggtttaaattgcttatagacaaatgttcaagggcatgtatgtaattatacctgggctgcgtcccgtacctagactctctcgcattcacgccttcgagcaagtcaaatgtatcaatgtaatattaatattggtaaatattcatttatgttttatagaatgcaaatataaatgaattaat

SEQ ID NO: 80448 - DNA, 353 bp, Zea mays
  unsure at all n locations
  Clone ID: LIB3088-021-Q1-K1-E11
ganctgngangaatcgaaccgncagcatcagaaggggccaaatgaactganggagcaggccaaagctgctgctcaggcaggtcttgaggagatggatgctgactaagaaacaggacgatttgcccagacttggtgtttttggtgctgttgaaatctccgatccctttggggtgacccactggacatggccaatttgtcacaatttattattttgacccatgtcatgtgaaactcctttcgttgaagtctggtatctagattgacttgtatcagagctgtggtttacgcagactggattctggagtactggactgggtgtgtgtatgtcggaactgtgcatctgacttttagct

SEQ ID NO: 80449 - DNA, 335 bp, Zea mays
  Clone ID: LIB3088-021-Q1-K1-B8
agcgaatccctcgaatcgtattctcagcctttgctgcatcgcacacccgcgcaaccccagcagccgcatccatggcgcccaaggcagcgaagacgcccgctgcgaaacagccagcgacggatgcaccagctgccgtgaatgcccgaacggcgaacaagcccatggccatcaagcgcctaccaacggccaagtcgatcagccaataatgcggctacatgaagggtaacaggattgcgaagaagtcggtggagacctacaagatctacatcttcaatgcgctaacgcatgtacatcccgacatgatcgtctctttcaaggccatgtacatcatgaac

SEQ ID NO: 80450 - DNA, 389 bp, Zea mays
  Clone ID: LIB3088-020-Q1-K1-H9
cccacgcgtccgccgcagcctctcgagctctactccatccgctcgatctcgaagcgcaggagcagcagtcaggcggccatggacgccagcgcatcatgagccggcgggaaggcgaagaagggcgcggccgggcgcaaggccggcgggccgaggaagaagtcggtgacgaggtccgtcaaggccgggctgcagttccccgtcggccgcatcgggcggtatctgaagaagggccggtacgcgcagcgcgtctgcacgggcgcccccgtctacctggccgccgtcctcgagtacctggccgccgaggtgctggagctggccggcaacgctgccaaggacaacaagaagacccgcatcatcccgcgccacgtgctcctggccatccgcaacga

SEQ ID NO: 80451 - DNA, 433 bp, Zea mays
  unsure at all n locations
  Clone ID: LIB3088-021-Q1-K1-A1
atgcaaagacgtttcttgaaaagagagactcagaagatatggagcttgatgatgccattgacactgcaatttggactttggaagaaggatatgaggggcaaatttcctccaacaacattgaaatcggaattattcgagctgatcgtgagttcaaagttttaagcccagcagagatcaaggatttcttggaagaggtggagtaagctgtctgttgatgatactagttcagacaacaatagcagcgtcacttatgagcagccagcctgaagattgtcttggttttattactctgtaaactgatttgctccagcgccatgtggtggttacatttgaaccctnctcaacgcatactgtagacaatgagataacgtaagatgaatgctgtatttgacatactttgcagcttgtttatgtgatgcacgttcttgcggac

SEQ ID NO: 80452 - DNA, 72 bp, Zea mays
  Clone ID: LIB3088-021-Q1-K1-A10
cccacgcgtccgcccacgcgtccgcgcacgcgtccgcccacgcgtccgcccacgcgttggcggacgcggggg

SEQ ID NO: 80453 - DNA, 291 bp, Zea mays
  Clone ID: LIB3088-021-Q1-K1-A11
cccacgcgtccgcccacgcgtccggacgttcacccaatagtctttttatacgcgctctggagctgtaaaagctaagagcggacttgtttttatgctacactgttttccgttgtatcattgtggtttgtttgtccagaggtgtgtagaaatactcaacatggaattgtgatgcttaaattgttgagcttgacaggacattatattgtgccaccaactcgccatggtctggaagttgtaataagagtgatcatgaaacagggcataaatctattgctagtacttttttagtgg

SEQ ID NO: 80454 - DNA, 355 bp, Zea mays
  Clone ID: LIB3088-021-Q1-K1-A2
cccacgcgtccgcaagtccgaggtgaacgacgaggactaggagggtgacgagtgatgtaggacggatgaaactgtgtccgagtgtttgcagtcagggaaaaaatctcgtcgttgtcggcctaaccgggttttctcgaaggactttctagatgcagtagattagtgccgtcttctgagtagtttccttgcaagtgtcgtcccgtccctggagtgaggcagtttagtttgtagtttcttcgcttcatcggcactcgaccgttgttggattgggatgtttagcctgcagtctgtacttgccccaagcatctatggtgcctgttttaaatctcagatcacaatatacgtttgttttaaa

SEQ ID NO: 80455 - DNA, 104 bp, Zea mays
  Clone ID: LIB3088-021-Q1-K1-A3
gcgcggacgcgtgggtgggtggcgaaaatgctggttactgtaccactagatcaagcatgttgtgcgtgtgtgaagaaatgccgattgtgacttgctgtttgttc

SEQ ID NO: 80456 - DNA, 441 bp, Zea mays
  Clone ID: LIB3088-021-Q1-K1-A5
gagtggttggcactaagaccaattgatcaaaataaattgcttggaaagccattacaacgtgcgttgaaccttgagttgtgttttctgaaagatagcatcaatcatagcacagaagggatacttaaagggggaagtaagaggcgtgctgcatcattgaatgatgtcagtaatcctttgccagaaaatgctgaatggagacaggtggtgttgcgtaatggcacctgtaaagagagacagtacactcagggctggaccattgatgatgaacctctctgcaaactttgtcaaggactttgcaatggaagacttgcaaagtcaccagaatattttgaagatctattctgtagtttagcttgtttccaggaatacagattaagaaccagtggcagggccctccggcaggcactgtttcaaatagaacgtggcaagtgcttccaatgc

SEQ ID NO: 80457 - DNA, 358 bp, Zea mays
  Clone ID: LIB3088-021-Q1-K1-A6
aaaaaaaaaaaaaaaaaaaaaaaaaaaaataaaaaaaaaaaaaaaaaaaaaaaaaaaaaaagaaaaaaaaaaaaaggaaaaaagaaaaaaaaaaaaaaaaaaaaaaaaaaaaaacaaaaaaaaaacaaaaaaaaaaaaagtaaaaaaaaaaactaaataataaaataaaaaaaaaaaaaaattggccagaaattgctaagatgtaaacagtttgtatcgcgtaatggcacctgtaaaacagatacatttcacctcaaaaatgaaccattgatgatgaacctttatacaaactttgtcaaggacttttcaatgtaagactttcaaagtcaccagaataattttcacatttattctgcca

SEQ ID NO: 80458 - DNA, 143 bp, Zea mays
  Clone ID: LIB3088-021-Q1-K1-A7
cccacgcgtccgcccacgcgtccgcccacgcgtccgcccacgcgtccgcgaagccatatgttagcttatggttgcaggagctggattcagttacgagcgagttgtgacagcaaaacttttatgaattacgttagaagtttcat

SEQ ID NO: 80459 - DNA, 266 bp, Zea mays
  Clone ID: LIB3088-021-Q1-K1-A9
tcggaggccgaaggaaaacaatcctgaaacctagccatggggtcagcagatggaaaggggggggcttcttagaagggaaaaaccttggcttggaacaccagcaatgggaacaagctgatcctctacgggctctacaagcaagccacggttggagatgtgaataccgatcgtgcgggcatattctaccaaaagggcagagccaagtgggatgcctggaaagctgttgaaagcaaatcgaatgatgaagggatgaatgactacattac

SEQ ID NO: 80460 - DNA, 281 bp, Zea mays
  Clone ID: LIB3088-021-Q1-K1-B1
gcgcccacgcgtccgcccacgcgtccgcccactcgtccgtccacgcgtccgcccacgcgtccgcaatcagagccaaggacccagcgtcctcctttctttccttcgactcatcacagcatgtcttgctgcggcggcaactgcgcgtgcacctccggctgcaactgcggcagcggatgcggcggctgcaagatgttccctgacgtggagaccgccggcgtcgccagcgtgaagcccacggtcctcgccgcccccgccaccaaggcgagcgccggcgggttcga

SEQ ID NO: 80461 - DNA, 343 bp, Zea mays
  unsure at all n locations
  Clone ID: LIB3088-021-Q1-K1-B10
cggaagcgcatcaagctcagcgccgagaaggcgatcttcatcttcgtgaagaacacccgcccaccaacagctgccctgatgtctgccatctacgaggagaacaaggacgaggacgggttcctctacatgacctacagcggcgagaacacctttgggctgctatgagtggcgccacgccgccgtggatcgacgtcggacaatgcccctcctcctgtaaatacttaaaaaaaataggcgtctcaagaatccgtgtacataataatctggcatggcttgcatcaaaagcaactcgntgcgtccactgtctgttgaaactattgaagcggactaaacatttaagcaa

SEQ ID NO: 80462 - DNA, 448 bp, Zea mays
  Clone ID: LIB3088-021-Q1-K1-B11
ctggtggcgagagaccccgtggtagccttcaagacggccatctggttctggatgacgcggcagtcgcgcaagccctcgtgccacgccgtgatgaccggcgactggaggccctccgccaccgaccgcgccgcggggaggctccccggatacggcctgaccacgaacatcatcaacggtggtctagagtgcggcgaggaccgctccaccgacggcgccaaagccgccaaggaccgggtcggctactacaagaggtactgcggtatgctcggagtggggtacggggacaacatggcatgcgggagccagaagccttacggaggatgatgacactagtagctgatctatggttgctgcaatgcaagccttcacgtgtgtttgcctctctacctaaagaataaatcaagcttgcagcaaacctaccttcggcgtgtgtctacttgcttatcat

SEQ ID NO: 80463 - DNA, 324 bp, Zea mays
  Clone ID: LIB3088-021-Q1-K1-B2
cccacgcgtccgtccacgcgtccggcggctgcggctgctatggtggcgggcgccgtgacggcagttatcgcggcggaggcggctacggcggtcagcgctagggtggtggccgaggctactgatgcggtggctgctacggtgagtgacgcgagggtggtggtggcggctacggcgaccagtgctgatgctgtaggtgactgatgtgtgagcccatactggcttctgacgagttatcttatctatctatagtatcgtgataccgaacactattgtcaccgtgttagtagccgatctacctttggattatgtgttggtacccctgat

SEQ ID NO: 80464 - DNA, 424 bp, Zea mays
  Clone ID: LIB3088-021-Q1-K1-B3
gcgctcaggactattgggcatggtttgcggttgttttttttaagtcttttgaacttagttaggtatttggtggttggtaaatgtagcaaccaactcgtcgttattatttatttggagttatggtttgcgttttttttgtgtgtgtgtgtgtgtgcaggaaatctgttgccaagctccttttgccccgacgtttcatccataacatcttcatcgttctcagcgttatcactggattccagaagtgaaaaatagcattaatcagagtcataccatgacattgacttatcaatgggctgcggatatctgtacagtacaagttgaagcacttttgaagccctcttctgttacacacgctagcagtgttgtataatgcttgtcttctgcttgcattttgactccaaacttgcagttttgctttttgtaa

SEQ ID NO: 80465 - DNA, 248 bp, Zea mays
  Clone ID: LIB3088-021-Q1-K1-B4
gggtgaatgggtcctcccggtaactgtttatacacctccattgcgcagacgagctactcatgagaggaatggtagatctgtctcacccggaaatatcttcaactcttgaagtgcactgttgccgaagtatagttactttcagctggaaaggatttacagactattctgactggtacaattgctgtaaattgttataggatttgcaatgtgatgcctatttttttaatagagaacaaatggagtgagat

SEQ ID NO: 80466 - DNA, 447 bp, Zea mays
  Clone ID: LIB3088-021-Q1-K1-B5
agcacagagagcatcaacagcaagctgcttctggtgatgaagagcgacaagggcaccctgagctacgagaccggcctcaagacgctgcgcaactccaagggaaagctgatcatcatcgcaaacaactgccctccacttaggaagtctgagattgagtactacgccatgctggccaaagttagcgtgcaccatttccacggaaacaatgttgatcttggcactgcctgccgcaagtactacagggtgtgctgcctcagtatcatcgacccaggtgactcggacatcatcagtaccacccctggcacccaatgagccagccccggaacccattgcagctgcttcgcctttctcaaaatgagatgagatgtatcgctccggacctatgtccggttccttttttatcttttagctatgtaaattttgctaccatgtggccatctaccatac

SEQ ID NO: 80467 - DNA, 396 bp, Zea mays
  Clone ID: LIB3088-021-Q1-K1-B6
cccacgcgtgcgcagacgagcggtggcgctgacggacaaggagcaggcggaagaggagttgtgccaaggcacactgggtatgtcgcgtgactcgatgcacaagcgccgagccaccggtggaaagcagaaggcctgaaggaagaagctaaagtatgagcttggtcgccagacagccaacaccaagttgacaagcaataagacagttatgagggtccgtgttcgtagaggtaatgcgaaatggatggctattggcctcgacactggtaactactcatgtggaactgaagctgctaccctcatgacccttatcctcgacgcggtctacaatgcatcagacaatgagcttgcgatgacacagaccgttgttaagagtgccattgctcacgttgatgctga

SEQ ID NO: 80468 - DNA, 319 bp, Zea mays
  Clone ID: LIB3088-021-Q1-K1-B7
aaccaaagttgacatctctggtgttgatgtcgccaagtttgatgacaagtactttgccagggagaagaagcaaaaggtgaagaagaccgagggcgagctttttgagacagaaaaggaggcatacaagtcactgtctgacttcaagaaggatgaccagaaagctgtggattctgctctgatcaaggctatcgaggctgacccggagctgaaaacctatcttggcgcactgatctctctcagggatggtgacaagccccatgagatcggcttctaagctcttacttctggagctcggaggaagctgttttgtctgtgatct

SEQ ID NO: 80469 - DNA, 331 bp, Zea mays
  Clone ID: LIB3088-020-Q1-K1-H8
ccttagaaacccatactcggagaagaattctaacaaggctcggaaggttgaagctatcgcatgaggtgaatttaggtacgcggagctcgactaaagaagtaacatgttatgccagcatgatcgacttcagtactctccaagtttctagaatcgacttgttttttagctatcgttttcattttggtcgttttgccaccttattcgatgttcgtcccttagctataatccttttgtaatggctttactgtgatgcgagggctcacccgatggcgtgtaatttgagcacaccaagcttaggcttcccttgcgaaagggtggaagcctttctatt

SEQ ID NO: 80470 - DNA, 340 bp, Zea mays
  Clone ID: LIB3088-020-Q1-K1-G10
tatcacacacatcacaccttcaacaagagtctctcttcgtaatgatagctatatgctcggtgttatcctaccaggcaaagttgatccattgcccaatctcatcaaagtacactagtttcctcatcctccatattatcttacactcaccctcgaccagcacatacactagatcaatcgtcatcatccaccatgccatcaaacacttgctactcaatatcatccacaaaataccccaactccacaatatctctcgttaagaacaccgcatggacgcctactcctagcacaagaccatctcctattgtcgcatcgtctgcgtgtccaactatcataatcgttt

SEQ ID NO: 80471 - DNA, 289 bp, Zea mays
  Clone ID: LIB3088-020-Q1-K1-G11
ttccgtttaaagcaagctgaaccatatttgtcccaggaacgtgcaaatgttccacggaatgaggttgacaatctgagacacattgttatggtaaaaaatgcacgaattgaggaagattatggcacccatatcgctgatcttgacataaatgagttacaagaccggcccaggcgaaggattgaagaactccaagtatttgaagggacacaccatgattttttcagcttgaaaactaggatggtgcctagcattggggagtttttgtcaaaaatggaggccctgaaacaaa

SEQ ID NO: 80472 - DNA, 265 bp, Zea mays
  Clone ID: LIB3088-020-Q1-K1-G12
ccgtcgaattccgggtcgccgcactcgcacgctccccacctcgcacctcgcggaaactgaagggggctcgaaccaggcgagaataactgatataggcaacaacaaaattgtccccgtttatgcttacccctgtgtgtgtctgtgaattgttataccgccctccctactgtctgtacagcgaagcgagtgcttgcggacactgggcgcgcgcagggaatgctcgaggcattcattaccggcaaaccacgccccgagatcaagatat

SEQ ID NO: 80473 - DNA, 172 bp, Zea mays
  Clone ID: LIB3088-020-Q1-K1-G2
gaataataattacagaacaatacattgaccggagatgcaggctgtgctatgttgttgttgtttgacaattttaagtaatacagacttaaaaaaaaaaaaaaaaagggcggcgttaagatccaagttactcctgctgcatctacttttatggcacctaatattatgccgcgtt

SEQ ID NO: 80474 - DNA, 450 bp, Zea mays
  Clone ID: LIB3088-020-Q1-K1-G4
tggacgaagccttccgttgttccaactggtggcagtccggcttaacctcaggctttaaaaaaaacccaaaatcctggtgatgtctgcccgtaggtgtacgactgcaggagcagtgtgttctggtgatgcaattaataagcatgatgttcctcatgttgagaactgcaacactccaactgtagccgtgtgcacaactttgaagcgtgtagcggagaaagttgtatcagagctagttggaagtgaaaggatggggaacaacaacagtgctgaatcgctggagagtatggaaaaggctgaaaatgtttgttttagtgggaatggagttagtcaaggtggccttccagaagagttagaggtatgaacaaggatacatcgtggaaatcattactgaggatcagtggcgtcaacgacacaaaattgaaggaagattgtggagatagacaagttcta

SEQ ID NO: 80475 - DNA, 396 bp, Zea mays
  unsure at all n locations
  Clone ID: LIB3088-020-Q1-K1-G5
ttacccttgtaccctgctatgctgtagcttctgctcttctgaacttgtaaatagcctgtcatggatgctgcatgcgtggttaatttcttgtattcacgtaaggtgatgctgttgtctcaatttacaactgtgcattgctgtttttgtcatccatgaggaagttatgcagttcggcaaatgttgtatatgtgtgtaggtgtatctgtatcaatgaatagcatgattattttgtaacagtattaggattccatctctgtttcaagcactactttaatttaaccccattatgttatgcgtggagatcaatatttatttcaagcaanatttatttattttatctttatataatatattatttttaatttttttatttatttatattattttttaattttt

SEQ ID NO: 80476 - DNA, 409 bp, Zea mays
  Clone ID: LIB3088-020-Q1-K1-G6
aaaaaaaaaaataaaaaaattatattaaaattttttttctaatatcccttcaaaccccccaaaagaagtttttttttaaacagagtcgcactcaccccctcctatccttactcaaaaccaatctattttttcttataaaaccctttatattctctcttatctaactttttactttcttttttttatattcctaatttattcttccctccctctccttttaataataatctctttcttccctttatcctcttttcttccttttttttttttttctcctccaatatttctttcctttttctacccttttttcacacatcctttccatcatatataactctctcctcctttttctcccatatttttattccctctctttttatatatactttctcctctttctccccctctt

SEQ ID NO: 80477 - DNA, 103 bp, Zea mays
  Clone ID: LIB3088-020-Q1-K1-G7
acgaagccttccccgaacccttggccggacccgtggtttttacccttttaaatcggtcctccttccccgccctgggtgagattaaagcggtaaagatccccgt

SEQ ID NO: 80478 - DNA, 465 bp, Zea mays
  Clone ID: LIB3088-020-Q1-K1-G8
tccggtgtcgacgacgcgtccgacgaattcgcctccggctctcctcttctcgagcgttttcggcaccacggcgcattaggatggcggctgctgccccgacgagagcataggtgctgtctctcttccgttccttactccgcacggcgaagaagttctcggactacaacatccgcgagtacactcgccgactcgccgcggactccttccgcgaaaaccgcgccctcgccgatgcgtcggccgccgccgcggcgttctcggaggggaagaagcagctagaggttgcgaagcggcaagcggtggtttactctctctacgcccccaaggccaagagcgtgatggagttgaaggtgcagtgatggctgcgaccttttcttccccaccgttcccgttccagattcgttgcttttgtgtgatgatgaaactataaactgctccgttgtcgcattttctggatgattgtcatgg

SEQ ID NO: 80479 - DNA, 438 bp, Zea mays
  Clone ID: LIB3088-020-Q1-K1-G9
cccacgcgtccgctggcctgcagcactggaggagattcgttagcgcagagactggtaggacctgtatgagatagggagaaaaggtaaacgattagatgacgagaggatgatgctatatttatcaagtccgcagcgccctgcctctcttgtgacggcccgcgacacaagtgtggtgattgacagtgacatcgctcactctaagttaggttttggttcttccctggcccccggaaatcatcacctggcgccgccacattcgaatggagatggatctgctggcatcatcttgcttcctcttttgtaaagcttttcctgctgagtttagtggtaccttagattgtcgtccatttctgccctgttctccgggcagctatttgtagtgtaaaaatatggtggcgtgctggatggtgttatttatgcgtgcgtggcctgtcatga

SEQ ID NO: 80480 - DNA, 443 bp, Zea mays
  unsure at all n locations
  Clone ID: LIB3088-020-Q1-K1-H1
cgacgacacgaagattcagaccccaccacaggcaccggaggaggagaagaaaggcctgcgtggacaagatcaaggagaagcttcccggtggccacaagaagccggaagacgctgctgccgccgccgccgcgccggccgtccacgcgccaccgccggcgccgcacgccgaggtcgacgtcagcagcccggatggcaagaagggcttgctgggcaagatcatggacaagatacccggctaccacaagagctcgggtgaagaagaccgcaaggacgccgccggcgagcacaagaccagctcctaaggtcgcagcgtgtgcgtgtccggcgatcagaagcgttgcgttggcgtgtgtgtggttctggcttgctttaattntaccaatgtttgtttcaaggtggatcgcgtggtcaaggtccgtgtgctttaaagacccaccggcagt

SEQ ID NO: 80481 - DNA, 231 bp, Zea mays
  Clone ID: LIB3088-020-Q1-K1-H10
tctcttcctatctttataccaatgctaattttaatccttcacaaaaaaaaacaaaaaaaaaaaaattgtttttttttaaagagtgacgtagatacaaaaaactaaatacaaaacatcaaaattcctcttcctttttatttactcccaacctacctttccttccatccaccatcattcttttttattctttatacctacatccatttcacttcccacctttttttacttttt

SEQ ID NO: 80482 - DNA, 301 bp, Zea mays
  Clone ID: LIB3088-020-Q1-K1-H11
gtctattaatgcaaacttcaacgacaagttcgatgaggtcaggaagaagtggggaggtggcatcatgggatcgggggcgcaggccaagaccaaggcccgggaaaagctgctcgccaaggaggctgcgcagcggatgacctagattgtctactgctgtgtctgccctgtagtttgacggggaagaactgatgaactcgtattgtggttttccgaatctagtttcatatgtttctgtccaccataccatgtttagaagctttgcaagacagagtttacagtgtttatgttatgcctcagatcc

SEQ ID NO: 80483 - DNA, 403 bp, Zea mays
  Clone ID: LIB3088-020-Q1-K1-H2
ccgagtgctacgtctacctgataccaccgttgaaaacagttgcctcctacagggagaaatgggatattatgaagcacgacgggtgcggcttcgacaaaatagaggctcaggcgagggtttctccattatggaaaagccatgcagggccaacactctaaaatggacatgacagctctattaacaggtaacgacgctttcaaactcacgccgtcatatttccgttaccatatacgtgaggcctgctcgctcttgatgtcgtccacgcccaaccgagtctctgccaaaccaaaccctagccgccgcaccagagcagccgcactgaaaaccccatggatcgaactgctccccgcgtcgctgttgcagaggctgtagatgctgcacgtgccgcggctgttgctgcggt

SEQ ID NO: 80484 - DNA, 438 bp, Zea mays
  Clone ID: LIB3088-020-Q1-K1-H3
atggttttaaactgtcagctgctgataatgatgtgtttgcaactgttcatccttttgtggtccgtgttagtgagggcgagttgcataaatatccacatgtactgcggtggatggactacattcagaacactgttggtgctggtacaactttgcaaaagataaatgtgaccaagtctgactttgatccaccttctcatccaaggaaagctgataaaaaagatgcttggtgatagaccatagaagattgtttctctgtttgacaagccacttcgatgaattgaacatatcttctaccagacaaaagcagggaaagctgttgtttaccatgttttttttgttgtaactacctttatgtaatttcctggatcttgcgaagcatggattttccctacaataatgcaaccggttgcactggcaactattcctgatgctacggat

SEQ ID NO: 80485 - DNA, 299 bp, Zea mays
  Clone ID: LIB3088-020-Q1-K1-H5
ccttcctccaacccttcctccaacccttcctccaattcttcctccaacgcgtccgctttgaactgcagaaaattgtgtgcgtggagacgagctaatatattcattacgtttaaaaaaaaaaaaaaaaaaaaaaaaaaaaaaaaaaaaaaaaaaaaaaaaaaaaaaaaagtttttatttaaaaaaaaaaaaaaaaaaaaaaaacatctaaacaaaaaaataaaaaaaaataaaaaattaacaaaaaaataataaaaaaacaaatatatttaaaaaatatataaaattggcgtcccctttt

SEQ ID NO: 80486 - DNA, 344 bp, Zea mays
  unsure at all n locations
  Clone ID: LIB3088-020-Q1-K1-H6
tctcccactcgtcctcccactcgtccgcagactctttttgtctcatgcgcaatccatncacagattgttcttttccgctgtgcgtgagaacatnacgaacccttatcccccgcatctcttcatgctccgttatgattgcccaattccaggtcagggcccaccgctcccatgttctgcttccacagcatctcctcctgctgccgctcctcgtacctaatttcaggaatgcgattcatggcttatttctctcacctattggataatggacttttcctgttttaaaaccaatgtactgtacccccctcatgttaaatttttagtacaaattttggttcgttctttac

SEQ ID NO: 80487 - DNA, 393 bp, Zea mays
  Clone ID: LIB3088-020-Q1-K1-H7
agcgctcgcaggagaggtcgaaaccctagcttttgcggcggcggcggcggagagaagatgatgggcgacgtgaactggcccctcttccgttccttcctcagccagaagggcggcgccgacaagaggaaaatggaggagcataaaccaaaggagcagaggcccaaggccaacgagaacaagcctgtgatgaacgaatgagtatctccagaagctttgttcaatgtgcaaccaagtccgatgtccgtttgctctggttagcttaaaaccaacgcttccaataatcctattggtgtcttagtttccccttatagtgttatttgctcggcttgaacatggcaaacggaaatgaaacttgaactacctatggtactgtcatcaatttgagacccccat

SEQ ID NO: 80488 - DNA, 400 bp, Zea mays
  unsure at all n locations
  Clone ID: LIB3088-020-Q1-K1-G1
aaatcttccaggcaaaacgtggaccaactttaatcagcagcagcgtcaggtggttaggcgctagcgaattaaatgaaggccggccgaacctcactgtcttgaaagattcagatgttctaatgtttaatgctttaccaccagtggttagtggttgctggttcatgcttcccaggttagagtcacgatttttttttttttttttgaggctgtagaaagatctgacgatacttcatgtgtgctttctctctgacgatggttccatacaggggcttaccaaagacgtagaatctatcgttgcagctccattgctctgagcatttctatagcttgaataaatctgcgtgctaggtttctatgcatgagacctgaaatttaaagagatgttggggtcaaaanaaaa

SEQ ID NO: 80489 - DNA, 417 bp, Zea mays
  Clone ID: LIB3088-042-Q1-K1-F4
cccacgcgtccgaatgactacaccccggagcagctcatcaaggacgccctgtccgtcaggaaggagacgctgcagggtgagaagctatccagctccaactgcacggtggccatcgtaggcaggaaggaggacggcaccatcgagccgttcgagatgattggcgccgcaaggatacaggaacttatcgactccatggaggtcgccgaggaggcgcccgcggaggaggccagctccatgcaggaggaggagaggggcccagaagatgctgctgctgctgcacctgcacccatggacatctagaagccccatatgaacccaccaacctcacgctgcattctgagttcccaaaagactagactgcttctttagaaaattgttgcgagttgtgactctttgcttacgaagaacttctctatg

SEQ ID NO: 80490 - DNA, 210 bp, Zea mays
  Clone ID: LIB3088-042-Q1-K1-F5
aaggcactcagtgctaccatatgcatatccatgcttaagtgcttgatttgccacgacgtgggatatcttttaaattcatcgctctggtgtgtaataactaattaagaacgacaccttcattctaaggttgtggtgtggcacttctatctatggtttttgtatttggaccacgaatgttgtaatttgtaaattttttttaaagatttatct

SEQ ID NO: 80491 - DNA, 317 bp, Zea mays
  Clone ID: LIB3088-042-Q1-K1-F6
cccacgcgtccgcttttttttttttttttttttttttttttttttttttttttttttttggttttttttgtttttttttttttttttttttattttttttttttttttttttttttttttttttttttttttttttttttttttatttttaaaaaaaaaaataaaaaaaaaataaaaaaaaaaaaaaatataaaaaaaaaaaaaaaaccatttaacaatttttttaaaaaaccaattctaaaaaagaccaataaaaaaaaaaaacatatttttttttagcaaaaaaaaaaaaaatccccaaaaaatagtttaatatg

SEQ ID NO: 80492 - DNA, 333 bp, Zea mays
  unsure at all n locations
  Clone ID: LIB3088-042-Q1-K1-F7
cggacgcgtgggtccgcctccactcctcgcgccgctgccgcatctcctctacaggtaagagggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtacaacatgaagtcaagggctgggagaggctntacccttgaggagttgaaggctgcgggcat

SEQ ID NO: 80493 - DNA, 410 bp, Zea mays
  Clone ID: LIB3088-042-Q1-K1-F8
cccacgcgtccgcttcaagggcgccgtgccggggctcacgcacatcgagcccaacaagcggaggctctgcctcgagctcgtgcagtccgcggtcatggtggccacgcgcgacgacggcggcgcgcacggcgacgccgggggaggtgggagcgacggcgggagcttcccgaggggcggcgacgccgccgacgacagcttggtgagcctcaccatgaactccacgctcatgtaccagggccaggagatggcggcggcgctggccggcgacgccaggaaagggagcggcggcggccgagggagtccgtccagcttgtacttccccaatggcttcgcatgagtatttaatctccttcatcaagcaagagcaatgcattttcgtttctctctacatatatccatccaaagatgat

SEQ ID NO: 80494 - DNA, 413 bp, Zea mays
  Clone ID: LIB3088-042-Q1-K1-F9
ggatgcttagaacggggagacgtctacctgataagtattagttagcagcatcgtgatgccaactgccggctatcatggttgtattggccctctgcttgtttctcatttccctttggagccagtttctctgttttgcgaggtcacacaagccttatttgtagtattacaacacagaagctggctgacccaaaatccgacactctgggggcagcaacttaacaaaatgtttgtacgagggtttagagccccacggtgcttctttggataagtatgtttattaccttgtacttagctaggaacctgcttatatgtaagatctttgtgtacgacggagaattgtcacagcggcataattctggtgcatcttggatttaatctcctgttctttgttagaccggccagtatgcagtagc

SEQ ID NO: 80495 - DNA, 447 bp, Zea mays
  Clone ID: LIB3088-042-Q1-K1-G1
cgacattcaggatgtggtgacaaaattggcaggcgatgctgcccatggagatggggacaccggttgccaggatggcgtgacgaaggtggcatacggcgcaacccatggagatggggacgttggttgccaggacggtgtgacgaaggtgacatgcggcgcggtccatggagatggggacgccggttgccaggatgacgccgcgaaattggcagcagaagccatgggatcagatcgaaacccaagctagccgataccagctactagaattatctttgcttctgagagaatacatgtctgtttttcatcacaactactagaattcaagaaaatcatcttgctatagattggtgtctattatgtacatggcactgaagttgcaactattcacaaactgcacagatgctgaaatttctcttcttggttggtttatttttctggacatgtttt

SEQ ID NO: 80496 - DNA, 446 bp, Zea mays
  Clone ID: LIB3088-042-Q1-K1-G10
cggacgcgtgggcggacgcgtgggcgtccgtcgtcggcgcggtgccacaagtagtagttgggcgttggtcgtggtagagtcgtccaccctcactcggagcttgccgagaggcgccatggttttatgaatggtgcatctcgctttggatctggggaattaccagtagtttaggcctagtattagcgcgggttttgtcgtgctggtgttagcctggttggtgtggtagcgttttgcttggttgttttggaattggaagtggtggtaaggctggcttgcagattaacggaggtaggccgccttttatcacccgccaattaagcatttgtggggtctcatggtgatggcctctttcagatgagatgttttgcgtgttacccaagtgtgttggttgtaatgagccctattaagtttgtgctggaacttcagtatgcatagacactgtctat

SEQ ID NO: 80497 - DNA, 440 bp, Zea mays
  Clone ID: LIB3088-042-Q1-K1-G11
ctcaggaggctacaaatgttgaaagtctattaaacggtcctactcttgaaattcggatacgggccgaatttgttacttccacgtaatcgtcaagtaaagggtgctcaactttggggaacagatatatatacaaatgattcagatcttgtggctgtgctaatgcatactggctattgctcgcctacgtgctgccctgccccatctgccatccaagagcttgatgcaactgttcaagttctaccaccacaagagagttatacttcaacattgaggaacaacgtacgctcacgtgcttggggtgctgagattggttgtagcttccgcatagaacgctgatgcatagttaagaaaggtggtggcaccattgatcttgaaccacgccttatgcacacattaactgtggagcctacacttgctccagttgctgttgaacgcacaat

SEQ ID NO: 80498 - DNA, 446 bp, Zea mays
  Clone ID: LIB3088-042-Q1-K1-G12
ggttgatgaagatgatgatggtgctgatatcaacatggatgggatggacttctcgaattgcggtggcatgggtggtatgggcggcatgggtggcatgggtgatatggctggtatgggtggtcttggtggcatgggtggtatgggtggtcttggtggcatgggcggtatgggaatggatgatttcgaagatgagagtgatgatgaagaagaagtgtcgaaacctcaagctgcggacaaggctgttgaggctgaggagacggagtcagcggaaaccaagattgaggcggctcagagcagttgaagatgcttatgatctaagctagattgtatcctcatgttaattctgctgaatcggaggacaaaccttacatttatggtgctggcaagtcccagtggcgtgccatgaaaatttacggtccgtctgttaactgggtattccagtgtcg

SEQ ID NO: 80499 - DNA, 438 bp, Zea mays
  Clone ID: LIB3088-042-Q1-K1-G3
agatattctgatccaagccaagatggcgagaagggggtctatgaacgactgatgatcccggtcctgaataatgacgcaatgtcaacaagtgagcgtattctccttcgcgaggatgctgaatgctgtatctgtctatcatcatatgaagatggagctgagttatctgctcttccctgcaatcatcacttgcactggccttgtattaccaaatggctgcgcatgaatgcgacgtgtccactctgcaggtataacattctcaaaggcagtgacagtgcatgaccaacttattctgacataactctcgtacacagcttcctttcaagtggcgttctcaaagcaatgctgtattcacagctgcgttattaaatgacagtgatctgcgtttgtatgattaggatgtgctgatcacctgtcgatggatgaaaccttatttacaat

SEQ ID NO: 80500 - DNA, 322 bp, Zea mays
  Clone ID: LIB3088-042-Q1-K1-G4
cccactcgtccgtgctacggtaccatatactgctcaccgggcgcataaccatgctaagagttatcacgggtatgatcaatttgtgatggctgattgctgacaaatggaggtggctgttcatatgttactactctatatcccacacgtgaacgcaatatgtcaaaagctgtatagccactgtatatgctacgaacgagagcaactgtactaagtcttagagctgcatcgataagtcctgaatactgatattgatgatgatacatctaatactgtattggtcacaactcctacctagccttgtggccacagcttctccgggact

SEQ ID NO: 80501 - DNA, 434 bp, Zea mays
  unsure at all n locations
  Clone ID: LIB3088-042-Q1-K1-G5
cggacgcgtgggctgacacgttgccggacgcgacagctgtcgcgacctctggcttaaggcggcatgatggctacacctttgacagccgcatccatggcatactgcatctcgctcagagcatcgatgaggacaattctcacgacgccagagctgaaatacctgctatgaaggattactcctatcagagcgagacctaggacgtcaactaagctgcacaccactcacgagtatacctctagacatatgactaccgaaatcttgactactgtttgaggactcactcacaacaacttgcttcctgcacaaacactcaatgagttccggaggaatcacatatgatacattgctatacagattgttcttgttatctggaatcctactagtatagtacatgttctacatgtcngttttgcctgaaaaaaaaaatnanannt

SEQ ID NO: 80502 - DNA, 296 bp, Zea mays
  Clone ID: LIB3088-042-Q1-K1-G6
cccacgcgtccgcccacgcgtccgcccacgcgtccgcccacgcgtccggagggccgtggagcacagcctggcaagcacaggccacgcaacctcgcgagctgcggaggtctactcgctggcttccaagactacgtgcttccagtggctgctaatgtttgtgatgacctgcatgtttgtaatggtggttctgctgataagggtcacttgaatgatgaggctgtagcaggcactcaaatcgtactcacccttgtcattgtttcatgggaattctttgtggtcaggtcatggtatttttc

SEQ ID NO: 80503 - DNA, 374 bp, Zea mays
  Clone ID: LIB3088-042-Q1-K1-G7
ttccgaattccggcgacggctctgcgcccagccctctacactcagcaccagttgggaccaacgaagcactagccgtcgaaacgagagaccaccagcagccgccgcagcagcagcagacaagctctccgtcgtcgccaccgcctccagatctcatcagcatctgagtaaccggaatcgaaaacgttaccgttcctcgcaaaaatccccgcttcagtgtagcaagcttaggtcgtaattttaggtttgcaataattaagtttgtttggcctcctgtgctgtacatatccgagtttgtttgttggctggttggttgtttccagtctgtcatgtttcatttgctggtgccgtgggggaggagtctgtagcgaagtgag

SEQ ID NO: 80504 - DNA, 437 bp, Zea mays
  Clone ID: LIB3088-042-Q1-K1-G8
agacaacatacaattcaatcatgaagtgtgacgtggatatcaggaaggacctctatggtaacattgtgctcagtggtggttcgactatgttcccgggtatcgctgatcgtatgagcaaggagatcacttcccttgcaccaagcagcatgaagatcaaggtcgttgcaccgcctgagaggaagtacagtgtctggataggagggtcgatcctagcctcgctcagcactttccaacagatgtggatatcgaaggaggagtacgacgagtctggcccggcaattgttcaccggaagtgcttctagggtttcacaagttcctcgtcgttacctagtctcaaattatgtcccctccatttctcgagatatgtgtggcagatttgcatgatacgtttggttggttccatcggacctgaagtcttcttggggatagggctcccc

SEQ ID NO: 80505 - DNA, 410 bp, Zea mays
  Clone ID: LIB3088-042-Q1-K1-F3
gggcgatgacctcttctacgagcacaccctgaccttgactgaatctctggggggcttccggtttgttgtgactcacttggataacaggcagctgctgatcaaatcaaatccgggcgaagttgtgaagcctgattctttcaaggcgatcaacgacgaaggcatgcccatgtaccagaggccgttcatgaagggcaagctgtacatccacttctcggtggagttcccggactcgctgagcccggagcagtgcaaggccctggaggctgtgctcccgcccaagccggtgtcgcagtacaccgacatggagctggacgagtgcgaggagacgatgccctatgacgtgaacatcgaagcggagatgcggaagcggcaacagcagcaccaggaggcctacgacgaggatgaggaca

SEQ ID NO: 80506 - DNA, 255 bp, Zea mays
  Clone ID: LIB3088-042-Q1-K1-D6
ctcaaaaaaaaaaaaaaaaaaaaaaaaaaataaaaaaaaataaaaaaaaaaaaaaaaaaaagaaaaaattagaaaaataaaaaaaaaaaaaaaaaaaaaaaaaaaaaaaataaaaaaaaaaaaaaaaaaaaaaaaaaaaaaataaaaaaaaatgggagaactttttaaagtttacaattttaatattcaataattcaaatatattaactttttaattttaaatccaattttaaatcaaaagcccaaatttttaaa

SEQ ID NO: 80507 - DNA, 247 bp, Zea mays
  Clone ID: LIB3088-042-Q1-K1-D8
cccacgcgtccgtggagtttaaagcctttgtggtggctcggtgctgttttttagggtgtgggctatgtggatggcatagtcatctttgagaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaagaaaacaacattaaaatgaaccaaaaaagaag

SEQ ID NO: 80508 - DNA, 430 bp, Zea mays
  Clone ID: LIB3088-042-Q1-K1-E1
ctgctaccagcaccacagcctagcaccccaccgcgtctagggttttctgctgcaatggccggcgcgggggcagacggggagcgcaggatcggggtggccatcgactactcggagagcgccaagaaggcgctggactgggccatcgacaacctgctccaccacggggacaccctcgtcgtcgtccacgtcctgcaccacggcgcggaggagaccaagcacacgctttgggccaagtccggatccccgctgatcccactctccgagttccgggagcccgaggtgatgcagggctacggcgtgcgccccgacgccgaggtgctcgacgcgatcgacacggcagcgcgccagaagcagctgaaggtggtggcgaagctctactggggcgacgccagggagaagctctgcgacgccgtcgaggacctcaagatcg

SEQ ID NO: 80509 - DNA, 339 bp, Zea mays
  Clone ID: LIB3088-042-Q1-K1-E10
cgaacagttggacacactgtgctgaaatggtgtgatggatacagtgacacattacttgcagatacatactgtgctgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaacataaaaagaaaaaacaagaaccaaaaaaacaaaaaaaattattaaaaacaaagctgacgatacaacgactgagggctgtgagaatcgaccaggattttaaagaacgacctttagttac

SEQ ID NO: 80510 - DNA, 191 bp, Zea mays
  Clone ID: LIB3088-042-Q1-K1-E11
gttctctgtgttcctacaattgtgacaaaatcatcgtcgttgaggtcggctcacatgcctgtaactgtgtagctataacaattattgtctaacgttgtccttgttactccacccgtttgtgttggattgccatcgaccatcatatgaaaacttattttttttccaatcccctccaatccatgtgggatgag

SEQ ID NO: 80511 - DNA, 261 bp, Zea mays
  Clone ID: LIB3088-042-Q1-K1-E2
caagtttgagagaaaaaaaaaaaaaaaaaataaaaaaaaaaaaaaaaaaaagaaaaaaaagaaaaaataaaaaaaaaaaaaaaaaaaaaaaaaaaaaaaaaaaaaaaaaaaaaaaaaaaaaaaaaaaaaaaaaatcataattataatatagagaaaactaaataaaaaaaacttgaccgaaaaattacaacgtaattactggaaaaaccctaactttcccaaacttaatacaacttgcagtacatactcaattttatagct

SEQ ID NO: 80512 - DNA, 436 bp, Zea mays
  Clone ID: LIB3088-042-Q1-K1-E3
ctggaagtgacctgagagccttgtgcgaataagctgcaatgatgccaatgggagagctggggccacatagtattcttgctattaaagcaaatcagttgcgacctttgaagtacgaggatttcaagaacgctatggcggctatcacgccaagcttgcataagagcaaatgggactagcttgagaaatggaacgaggaatttggttcgagctgacagcggctcgcactgactgtgcctgatgatgatcaagcggtcctatttccatctgtatatatgatttatgtctcccaccctgtggctcacaacacacggggtcacaccatgctcccattgatgcgtcctcgttgggctaggcattacaacatcgacagaatcagaatgtaaaggtatacttctggcaacgggctatacagccaatgagggctagtttgaaacac

SEQ ID NO: 80513 - DNA, 357 bp, Zea mays
  Clone ID: LIB3088-042-Q1-K1-E4
cccacgcgtccgcccacgcgtccggaaagagctggcggagtgtagtctcgatgaggattgtaaaccgagaaagagcttagattctttttgtgcggtttgaaggccccctccctctccatgtagcagttgccgtattgtgtaagcgtaacttgttgtttctcattattatcatccccttttggtccatttgtataacctgtatcgcccatgtctggtggtggacaatcggtagtttttgtgtgttaatataaggtgctaggttttcccaccatgccgattgtaaagttgccctggtgcgcattgcactgcgatttgtacggaatagggaaggaaaaatttataggttttgctttgtgc

SEQ ID NO: 80514 - DNA, 382 bp, Zea mays
  Clone ID: LIB3088-042-Q1-K1-E5
gggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaagagctatcttctgttttatcattgtctctgtttctgtaagctagcaagtgatgctgtgatgcttttattaagattctgatgagtggtgacgttaagagaaaattggcagtactgtgttgtaccccaagattccttgcagcattgctatgct

SEQ ID NO: 80515 - DNA, 438 bp, Zea mays
  Clone ID: LIB3088-042-Q1-K1-E6
caacattatggctaccttcggtatgggtcacctcaccccgagtcagaatgaacttatccgttgcagatttgtggcgaaaagtgagcaacaatgtgcataaagagaaagaaaaggaataaacaatgctattatcttggaggcctggtgcatttggcggcaaagaaatcgtacggtttttgaaggagatttgccggctgttagcaaggtgcagcaaagttttctagaagagctaacatgtttggtcttgactggggctcatcaccttagcattttagggataattgatacccttagagcggtcggattgggctctcttgatcatatgtaatttttgtttcagtttcgatgtggtgtgggtgatgatcttgcttaacaggatactcatcttgtaagactttcttttctctctctaaatataaataccggacgcgttcgaag

SEQ ID NO: 80516 - DNA, 403 bp, Zea mays
  unsure at all n locations
  Clone ID: LIB3088-042-Q1-K1-E7
tggagtactgcttttatgtgaggttgcattgggcgatatgaatgagctactgaatgcagagtacgatgctaataacctgcccaaaggaaaattaagtaccaagggagttggtcaaacagcacctaacatggtcgagtctaaggtcgctgacgatggtgttgttgttccccttggcgaacccaaacaggaaccttccaaaaggggtggcttgctttataatgagtacatagtgtacaacgtagaccagataagaatgcggtatgtcttacatgttaacttcaatttcaagagacggtagatgttgcaaagagctgaaactgttgctgagatcttagcagaacatatgtggacttatagcaccaggtgcnctcagcctcattttctgagcaaattggtagccctt

SEQ ID NO: 80517 - DNA, 388 bp, Zea mays
  Clone ID: LIB3088-042-Q1-K1-E8
caagcaatctcttcttgactgccgagatggccaatactctatctccatggccatggttcgattgcgttcgagagtgtgtgctgtggcagtttgatttattggatatatcggctcttcatgcatcgagaattggtttttcatttgtgattatactgacggaatctatcaaagtgctcaagatgctgctagtagaccaaggtgttgcaggacatttctttgtcatgatttgggatcctggtggaattgatgccatgtatcggcttgagggcaagccgaattttaagaaggggagaatgtcagcagcccgacatctgaaccatgagccactgtcactgtctcaaccaggaagctggaccaagacgagcatgtagctgatgaagatactttc

SEQ ID NO: 80518 - DNA, 414 bp, Zea mays
  Clone ID: LIB3088-042-Q1-K1-E9
cggaccctgatgggaggcggacagagatcatatgtactgcttgtggaggacacttggggcgacatattcaaaggggaggggtttaagacgcctaccaacgagcgacactgtgttaacagcatcttgcttaagttcaatccgtcccccgaggaagcctgacggcagatgaactcccaatctgtaactcaacaacagaatagatctggactttgtttgacgctttcacattgcgtagagagctatgagatcgaatttgtcattcctcggatcatttggaatatgatgtgaaaaatgcaatctcaagtgctggtctttggtgataaatcaatgtacctcagttatagatgaataggccatgtatatgctcatgctcaaagaactaacttagaagcagaacccttgttttgttggtct

SEQ ID NO: 80519 - DNA, 299 bp, Zea mays
  Clone ID: LIB3088-042-Q1-K1-F1
tcgcatctcgctccttgtcgacacgacattcaccatgcaagacagcgcctgggacttccgcaagcaatccaagaggctccgtagagctctttggatgaagaatgccaagcttctagttgtgttgacagttgtcatagtagtgctgctctacttgatcatttctgctttctgtggaggccttaccttgtcatcatgcagatcatgagtaacacaccagatggctttgcccctcccttaaatggagggtagaacaccatggaatgatgcctgctgtgttgagcaccggagctttcggaggc

SEQ ID NO: 80520 - DNA, 434 bp, Zea mays
  Clone ID: LIB3088-042-Q1-K1-F10
cccacgcgtccgcttctcaaaaaaggcttttttgaaattaggatacagaactgtgcgtcaaacatggtgaacaacagagagagggagaagatttttgtagccagccaggagaaattccacgccggcgcagacaagcagtactggaaatcgatttcggatctcatcccacatgaaatagccaccatcgagaagcgggggaagaaagacaaggacaagaagccatccatcacagttgtccagggccccaagcctggcaagcccaccgacctctcccggatgcgccatatcttggtgaagctgaagcatgctccgccgccacatatgttgcagcctccaccaccagcacctgctgctaaagagggcacataggatggcagcgccaaaggtggtggaaaggatggtgccaaagaaggcggcgcggcagccccagcaaa

SEQ ID NO: 80521 - DNA, 445 bp, Zea mays
  Clone ID: LIB3088-042-Q1-K1-F12
gtgcgcgcattcttcgatgtgcatgatcattaaggaagtcacccaggaggcatccaccttgaaatgagtgggcagaacgtgaccgagtgcattggtggatcacggactgtgaccttcgatgacctgagcgaccgctaccacacccactgtgacccaaggctgaacgcctcccagtccctggagctcgccttcatcattgcagagaggctcaggaagaggaggatgcggtcggggctcaacaacagcttgcctctgccaccactggctttctaagtagccgaagctgaacagagaaggtagagggatagttgcggcgactcgaaagattacgcatgtttatttgttgatgcttggtgtggaagactggtgggtgctcttggcacaagttacatgctggggagctataggagggtacctgttgcgttgtggaagacagtagctagta

SEQ ID NO: 80522 - DNA, 377 bp, Zea mays
  unsure at all n locations
  Clone ID: LIB3088-042-Q1-K1-D5
gctcaccacaccaaccagcaagcaaaaatttcccaatcctctcgtctccgcggctaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcccttaagcgccagggccgcaccctctatggcttcngcggctaggtctgcc

SEQ ID NO: 80523 - DNA, 386 bp, Zea mays
  Clone ID: LIB3088-042-Q1-K1-B9
cggacgcgtggggctcgtacgaagcagacttcccgcatgtccaccggaggcaaggccacggcgcaagcgagctcgccaccaaagctgcgaggaagtcggcgccgacgaccggcggcgtgaagaagccccacaggtacaggtccggcaccgtggcattgcccgagatccggacgtaccacaagagcaccgagctggtcatccggaagttgaccttgcagcgcctggtccttgagatcgctcaggacttcaagacggatcttcgggtccagagccacgccgctctggccctccaggaagacgccgaggcctacatcgtcggtgtgttctaggacaccaacctctgcaccatccacacctagcgcgtgaccatcatgcccaacgacatt

SEQ ID NO: 80524 - DNA, 213 bp, Zea mays
  Clone ID: LIB3088-042-Q1-K1-C1
cctgctgtcatgcatttaagttttggagaccaaaagggaaaattagactaaattataacaaccaaaaaaacttaaatataaaaaaaaaaaatataaaaaaaaaaaaaaaaaaatatcaaaatctaaaactaaaaaatatccgtataaaccttaaaaaggccaaatttaaatagtcaaatttcatatgttaactacaataatcatgctaataac

SEQ ID NO: 80525 - DNA, 302 bp, Zea mays
  Clone ID: LIB3088-042-Q1-K1-C10
gctttatgatcctcaaaaagcagatggctttccataatcccatgcaagatgatctgccggggaaccagctacatgttaacactctcatccataccagccaataccgaataatatcatactcctagaaaggcttcacaggccgctatataccaatgtattgtaggaaaaaacatcttgggttacccaagctaaaccaccttgaacatcatggcacctgtctccaacatagacaatatgagagaagaccgcatagatcgctgttctgaacaggggcatcaacctacaatgagcgaaggggacac

SEQ ID NO: 80526 - DNA, 72 bp, Zea mays
  Clone ID: LIB3088-042-Q1-K1-C11
cgaaatgatctcactaacatattcaaggatttcatttcgacaatgaaagttgagaacagaagttacaatgtc

SEQ ID NO: 80527 - DNA, 439 bp, Zea mays
  Clone ID: LIB3088-042-Q1-K1-C3
cccttttctgatctggcaggtcgggacaatcatgcctatagcattgactggccttttaagcttcatgttctttctgctaattgccactgctaatgcgatcatcgtctcagccctgatgtcactggccgctgctggcggattcttggctatcttctttgcttgcttggttgcagtgtatattggagcagtaggagttgctatctttgccatttctgccattgtcatctcatcagttgttggagttatgattactactggttgggttgggttcttctggatgatctggttcaccgcaaggaagagcatggacctgacgaagcattccatcagcatgacgagctcggcagtccaatcctattccgcgtcccgccaagtgaagcataagcatgtcgactgaggctagttggttgcgtcttgcgtcctcgggtcgatctgtgtg

SEQ ID NO: 80528 - DNA, 272 bp, Zea mays
  Clone ID: LIB3088-042-Q1-K1-C4
gtttcttttattaaagggtcgtccgagtttcttctactaaatggtgggtcagaccgagttgttgtttttgtttttggtctgaattgaatagagtgtctgcttgttaagactggaatgtgttatgtgcctttgttaagactggaatgtgggaatctttgagtgattcggcatgtaactaactggaggccacgagatagtttgacgcaaggcctattacccccttggaggagagtgacgatcaaaaacaaataaactaacaataaacaaaaata

SEQ ID NO: 80529 - DNA, 396 bp, Zea mays
  Clone ID: LIB3088-042-Q1-K1-C5
gtttaaaacgtttgaagaacgagagggaggaaacaattggaaaactgcaaatagatattgggtcactgggactccagtgtgacaacttgaaaacttcgctgtccaagaaagagtctgagaaagacagccttgcctctcaggttctgaagctgagaagatccgttgaaacccgggaaagggcgaaggcaaatggtcaaatttcagatgtgaaggacaatcagcatgctaataacaagcgcaccaagcacaataccggctccactgggagcattgctgcgctgccaggcaccaacagacaaggcgaagacggtgactgcaatggtcctgacatgaggaactccactgaccagtcagcaaaggagctggcctcactgaaggagaagaacagggcgatcg

SEQ ID NO: 80530 - DNA, 413 bp, Zea mays
  Clone ID: LIB3088-042-Q1-K1-C6
tccttcctttggcaaatccttggtggcaagcaagaaaaggctggttggagatgtggaagagcaacttgagccagataaaaacgatgatggggtgcaagcaacgcagcagcagctagagctcacaaaagagaacactgaagcaagagcttcaacatgttccacctcccaagagcttcaacatgttctgctccggtggctcaagaggcaagcgtcgcacccgccccgattttgattccaaggacgaatacaacattcccgccggactagcgatcaccgtacctcctgtgcctcgaggtggagccgcccgtctgcgactcgcgcagaccacatctaacgcgtgtggcgctcgtccggctcacgggcaagcaccccttcaacttaaaaacctcggtgtcctggctgatggggcacga

SEQ ID NO: 80531 - DNA, 425 bp, Zea mays
  Clone ID: LIB3088-042-Q1-K1-C7
cgagtctccagccaaccgcatccagtccaccccatccccctcgaccccgacaaccccgaggcccgacccgatggcgcccaaggccgagaagaagccagcggagaagaagccggcggccgaggagaaggcggagaagacgaccgcaggtaagaagcccaagtccgagaagcgcctgcccgcctcgaagtcctccggcaaggagggcggcgagaagaaggggaagaagaaggccaagaagagcgtggagacctacaaaatctacatcttcaaggtcctgaagcaggtgcaccccgacatcggcatctcctgcaaggccatgtccatcatgaactccttcatcaacgacatcttcgagaagctcgccggcgaggccgctaagctcgcccggtacaacaagaagcccaccatgaccttccgcgagatcc

SEQ ID NO: 80532 - DNA, 430 bp, Zea mays
  Clone ID: LIB3088-042-Q1-K1-C9
tcgtccacgcgtgcgttcactcgtgctgacagttcaagtgacgagattagaccgagcatttatgagcccgaaggcattgaaattgtaggatctggagtcacatcaatgccataagaattgtcgattacggaaactgaaccaaaccagtttaacaggatcagattcatccgaaactgacatgacttcacattgtgtaatttatagtgacaaagtccttggtgtacacgagttagttctgacagattgtacagttcttctgggtagaaagcaaaatctgatagtgaacacatctgacctgatcgcgaatgcttgtatagccgtctcacctacttcagaaatgtaacttaacagtggattagagttgacctatgttaagagttgtcaagttttgaagtggaagaaatatcttaaccatttgaaaaaaaataaa

SEQ ID NO: 80533 - DNA, 429 bp, Zea mays
  Clone ID: LIB3088-042-Q1-K1-D11
gccatgctggtgatcttggaaacgtgacatctggagcagatggtgttgctaatatcaatgtcaccgacagccagatcccactgactgggccaaactcaatcattggcagagctgttgttgttcacgctgatcctgatgatcttggaaagggtgggcacgagctcagcaagagcactggaaacgccggtggccgtgttgcttgtgggatcattggactccagggctgaaaacgatcgccggacttgggggtgcctgagaggtccgtcttctgccgtccccagcagacgagcctgaacattcggagacatcgtgaaataagagcgtcgctgatctgtgatcatcgtatttgtcattatgcacctgtagcaaccgatggactgaactgtgctggattatgctgttggatcacctgagtatgtggtacatgtc

SEQ ID NO: 80534 - DNA, 438 bp, Zea mays
  Clone ID: LIB3088-042-Q1-K1-D2
cccacgcgtccgattttcttccattttcttatgggactaaactactcagataagctttaggaaggtggcttacaacgggaccttttcttgccatttattgacaccttgaaagaaagatgcatcgtgcatgccattggatctgcggtggactatcgtcaactgggttctgctgaacaaggtttctattttgtcggaaaacattacagtacgcttctgaaacagaagctccagtctttaattggagatgagaaacccagcccacaaactgttgaagtaattatgggaaggaaattacaggttcccctaggagcaaatggttgtgcatattttccttttgaagacctttgtgataaacctttaggtgcagcagattactttggactctttaaaaaatttcacaccctggcacttgatggtattccaaaagctgggtctagt

SEQ ID NO: 80535 - DNA, 210 bp, Zea mays
  Clone ID: LIB3088-042-Q1-K1-D3
cccacgcgtccgcggacgcgtggggctagtcatccttgccgacgacgatccatgtctctggatctgcgtctgttcatatgcctgatgccgacttgtgctgtatgtagttgcttgaattcagtcgtgttttgctaccgtacccaccccatgcatcatctgtcaccgcgacgcaataatcatagtaataacaagttcagagattgattcatt

SEQ ID NO: 80536 - DNA, 442 bp, Zea mays
  Clone ID: LIB3088-042-Q1-K1-D4
atggtggttacttatatgtatgcggtgatgccaagggaatggctagagacgtacacaggaggcttcatacagtagtccaagagcagggatctttggatagctccaaaaccgagagctacgtaaagagcctgcagatggaaggcaggtacctccgtgatgtatggtgacacatcacccccattcagccatagctctagcgtgtggaagtaaagctggctttgcgtgtacgacatgcctaatgccaaatgaagcgtgccattgtttagaaactgaaatgttcagtcgatcagtgtaattctttgacatctaactattttatcattatatggaatgggaggaactgttgtagatttgtagaactacaaaaaaattgtgtatccctaacaagtttgtagcaaagggggtacattattacagtttgagatgaagacatcatgtatac

SEQ ID NO: 80537 - DNA, 405 bp, Zea mays
  Clone ID: LIB3088-042-Q1-K1-B7
gctggaggcacaccatctgctaaatatacaacgtgagtgcatccctgtcaacagccgtgacaatgtgggtgctagtgttgagactgcccccgagagggttaccagctacaacaccatcgcctacaacgttcgattgaaaaatgctctggcaaaccataaggactttcacattgacatatgccctcatatactcacgatgaacctcaataaggatcaccatgactaataacgcctgaaattacacgtacttgtagaggtacaatatatgtatcaagagattgaaatggtctataacctgtaaatctatcactaagagcatcaatattagcacttattaaaccttattactaccgatgttactacctaatttatatacttctctaaaaattatgcttaaaaaaatat

SEQ ID NO: 80538 - DNA, 254 bp, Zea mays
  Clone ID: LIB3088-007-Q1-K1-A5
aaaattggcatggccaagacgatacgattccaaagctaacagatgctgctgcacagaagtagggtagtccctttttgtacctctatacttttgatatggaaaatcatatacagttcagttagtctgtttaacattcgatttcacttgctccaaacgaaaaatgcgatccaatgttcgtgcgatttctgtgtaaaactgttatacttttaactgtcctcaactatccatttttttatatataatgtcttggtgtt

SEQ ID NO: 80539 - DNA, 415 bp, Zea mays
  Clone ID: LIB3088-007-Q1-K1-A7
cccacgcgtccgcccacgcgtccgcggacgcgtgggttggtggggaacaagtgtgaccgggctgagaacagagtagtttcttacgaggctggcaaggcccttgctgatgacatcggaataccattccttgagactagtgccaaggatgcaacaaatgtggagaaggcattcatgaccatggcaggggagataaagaacaggatggcaagtcaaccagctgcaagtggtgctagtaggcctgcaactgtgcaaatgcggggtcagcctgtttctcagcaaagcagctgctgctcttgatcgtctgtctagatcacagtagtgtgattgtgcagcaagcaaaacttaaattggttgctccctgtacattaagcctattactgtcccaaagaactcgatgttatctatcggatactgg

SEQ ID NO: 80540 - DNA, 434 bp, Zea mays
  Clone ID: LIB3088-007-Q1-K1-A8
cttcgtacaagctctcggacgccgccaagaaggcatcccccaagaccaaggctaagccggcaaaggccgccgctgccaagaccaccgcccccaagccggccaaggccgccgccgccaagtcaaagaaggcagcggctgccaagccaaagaaggccgctgctgctgggaccaagcgcaaagtgcccgagaagaaggtcgtggcgaagccgaagaagtcccccgccgccaaggccaaggccaagccgaagaccgtgaagtcccctgcctccaagaaggcacggaaggcctccgcatgagatgggttgctttaggtctaagctctgattgtggttggtgtcagttaggtactgtacaaactaagtgtgtgcccaaagtgtctcaggcggtgtgttatgtgcttagcaagttctatctatcagagtgttttagtttaa

SEQ ID NO: 80541 - DNA, 439 bp, Zea mays
  Clone ID: LIB3088-007-Q1-K1-A9
tgttgatacaaaaagagaagagagaatggcggagccaaacccagagttgagtgagcttattactcaaacaaagaagaagaatatagtgccaaagttcaccgaaatcttgcccgtggaggacacggcctacccttacagcgccttcatcacctccgtccggaaagacgtgatcaaatactgcaccaaccatacaggcatcgtccagcccgtgctgccgctggagaagaatgtccccgagctctggttctacaccgagctcaaaacgaagaccaggtccatcacgctcgccatacgtatggacaacctctacctggtcggcttcaggacccccggcggggtgtggtgagagttcggcaaggacggcgacacccacctactcgacgacaaagccaagtggctcggctttggcggtcggtaccaggacctcatcggcagtaag

SEQ ID NO: 80542 - DNA, 439 bp, Zea mays
  Clone ID: LIB3088-007-Q1-K1-B1
cggacgcgtgggcgaccccgattcgtccgtccgcgaccgggattccctccgccaagcgcggatctgagcgctgcgctccgtgtcgtcgctcgaatccgccatgaagggggccaaatccaagggcgccgccaaggccgatgccaagctggcggtgaagagcaagggggcggagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgag

SEQ ID NO: 80543 - DNA, 409 bp, Zea mays
  Clone ID: LIB3088-007-Q1-K1-B10
cggacgcgtgggaaacaacaaatataaaatagaacagaagaaaaaaaccaaaccgagatagaaaaaatacgagaggagctcggtggaaagtaacatcaagcttgtggctccagcgtccagaggatgcgtcactgatgagtaggctgtgttacattctgttcggttgcgcacatgatgcgttttcaatccaaggctgtttgccaggaacaaccatgctgttagagtgactcatgatagcgcagtttgcgtatggcaggtataataataaaatgcccgtttctattagctcagcaatgctacagaatctgctgaataatcgaccgtaatatgtctgtttaagcttgtgagcaatcacatccttttcagtctctcacttgctttgcttgtcccattgcctctactaccttgt

SEQ ID NO: 80544 - DNA, 429 bp, Zea mays
  Clone ID: LIB3088-007-Q1-K1-B12
gtttccccttcttccccatcgcgtgccctcgccgcagccatcttccatggcggaccagctcacggacgagcagatcgcggagttcaaggaggccttcagcctcttcgataaggatggcgacggctgcatcactaccaaggagcttggaactgtgatgcgctcccttggccagaaccccactgaagcagagctgcaggacatgatcaacgaggttgatgctgatggcaatgggaccattgacttcccagagttcctgaacctgatggcaaggaagatgaaggacaccgactccgaagaggagcttaaggaggcctttcgcgtcttcgacaaggaccagaatggtttcatctcggctgctgagctccgccatgtcatgaccaacctcggcgagaagctgactgacgaggaggtcgacgagatgatccgtga

SEQ ID NO: 80545 - DNA, 289 bp, Zea mays
  Clone ID: LIB3088-007-Q1-K1-B2
cttggtcatgcatactcagaggatccgtcatggcgaagaaccccaaggtgttcttcgacgtcctcatcggcaagtccaaggccgggcgggtcgtgatggagctcttcgccgacaaggtgcccaagacggccgagaacttgcgctgcctgtgcacgggcgagaagggcctgggctccgcggggaagccgctgcactacaagggctcggccttccaccgcgtcatcccaggcttcatgtgccaaggctgcgactttacgccgggcaacggcacgggcggcgagtccatata

SEQ ID NO: 80546 - DNA, 368 bp, Zea mays
  Clone ID: LIB3088-007-Q1-K1-B3
gtgctgcaggcagtgcttccgaagcaacgtcaaggacattggtttcatcaagtaccgtggaagagggcactgtgctgatgtggagaacttcctacatcaaacaaatgggtccttcattacaaggcctaatttatgcgctttagctctttggtcagaacttgagactcatgtgttaaactcgacttgctaaagacttgatggctactttgtgcttgttggaccagctataatcagaagattgaaattttctcaaaaaaaaaagcacagcaacgggcagagagtacatatactgcgccaggatcgtctactaaaactgtaaaactgcgcaaaaaagggccggccgtgttcaggatccaaaattccgtacc

SEQ ID NO: 80547 - DNA, 403 bp, Zea mays
  Clone ID: LIB3088-007-Q1-K1-B4
ccaacgcatgccgattcccccgaaaccttttcctctggaggaaggaagtccaaccgagcgggctacagtggcggactcgtcggccccgacgagagtgatgatggcatggaacgagtagtcgcttaaggagtacatgcactcctgcatcagctgtcgcactcgctactactggacgctattcaagctcgtacggtccaaccctgtgggctttcactgcctgttcgtccacgttcatgtacacgacgaggactgatttgatgacatggatagcatctatgcttcgccggaggactttcaccaaatgaagcaaagagacatgataagagggcttcatgtgctcgagtactttggaaaccaatgccatcagctagggataaaatgcgaggcatggatcagacatgga

SEQ ID NO: 80548 - DNA, 461 bp, Zea mays
  unsure at all n locations
  Clone ID: LIB3088-007-Q1-K1-B5
cttacattttgcatgtgggtacggtgagttgaagtgtgcccagatccttcgtgaagctggtgctgcagtggacgctcttgacaagaacaagaacaccccgttgcattacgctgctggctacggccgcaaggagtgtgtggatcttcttttgaagcacggtgctgctgtaactctccaaaacctggacgggaagacacctatcgatgtcgccaagctgaataaccaggacgaggttctgaagttgctcgagaaggacgccttcctttgaataccatgcctttcgtatacacttggactcttggtgtcatgtttttttttcataccggttgtttttgtctggatagccacatgtcatggtccttaaatctngtatgcctaaatgctattagcatgtgggtgttcgaactggcctgtaatggtctaccgttcgtgacttgggttttccactccatttctgatac

SEQ ID NO: 80549 - DNA, 443 bp, Zea mays
  Clone ID: LIB3088-007-Q1-K1-B6
cttacattttgcatgtgggtacggtgagttgaagtgtgcccagatccttcgtgaagctggggctgcagtggacgctcttgacaagaacaagaacaccccgttgcattacgctgctggctacggccgcaaggagtgtgtggatcttcttttgaagcacggtgctgctgtaactctccaaaacctggacgggaagacacctatcgatgtcgccaagctgaataaccaggacgaggttctgaagttgctcgagaaggacgccttcctttgaataccatgcctttcgtatacacttggactcttggtgtcatgtttttttttcataccggttgtttttgtctggatagccacatgtcatggtccttaaatctgttatgcctaaatgctattagcatgtgggtgttcgaactggcctgtaatggtctaccgttcgggacttgtgtttt

SEQ ID NO: 80550 - DNA, 459 bp, Zea mays
  Clone ID: LIB3088-007-Q1-K1-B7
tgcacttcccacatgtgcccgataagaatccactggcatgtgaagctcaactacaaggattactggagagtgaaaatcactatcacaaacttcaacttccgcatgaattacacgcagtggaacttagtagctcagcatccaaactttgataatatcactcagttgttcagcttcaactacaaaccacttactccatatggtggtggcataaatgatacggcaatgttctggggtgtaaaattctacaatgatctgctgatgcaagccggcaaacttgggaatgtgcaatcagagctgcttctccgcaaggactcccggactttcactttcgaaaagggatgggctttcccacgccgagtttacttcaatggtgataattgtgtcatgccatctcctgaaaattatccatggctgccgaatgcaagccctctaacaaaaccattggcacttccattcttg

SEQ ID NO: 80551 - DNA, 407 bp, Zea mays
  Clone ID: LIB3088-007-Q1-K1-B8
cgatctactacagcaggcacttgcaatgtcaatggagggtggtgcttcaggatctgcagctgtgactgactctgctatggcagaagctggtgcagttgaccctgacttggcattggctcttcaaatgtctgtccaggatgcaaacatgtccagtgacactgatatgagtaaggtgtttgaagacagaacgtttgtgtcatctatccttaattcgcttcctggtgttgatcccaatgatccatctgttaaagatttgctggcatcgttgcacagccagggagagcaagagaagaaggaagacacgtcagacataacagacgacgagaagaactgatgtagccatgttcacgccttcatgcgcacaaagaaattgaagaccggtctgcgtttactctctaggtcgtgga

SEQ ID NO: 80552 - DNA, 419 bp, Zea mays
  unsure at all n locations
  Clone ID: LIB3088-007-Q1-K1-B9
gttgaccttaccgaacagcagctcgaagaaaggcggaggaaatggaccccaccggcatacaagtcgaccagtggagctctttggaagtacatcaagcttgtggctccagcgtccagaggatgcgtcactgatgagtaggctgtgttacattctgttaggttgtgcacatgatgtgttttcaatcaaaggctgtttgccaggaacaaccatcctgttagagtgattcatgatagtgcggtttgcgtatggcaggtataataataaaatgccggtttctattagcttagcaatgctacagaagctgctgaataatcgagcgtaatatgtctgtttaagcttgtgagcaatcacatccttttcagtctctcacttgttntgtttgtcccattgtttctactaccttgttcacagagatgatc

SEQ ID NO: 80553 - DNA, 242 bp, Zea mays
  Clone ID: LIB3088-007-Q1-K1-A4
ctaagagcgacgttacttgtcagtcaatgtaaataaccaaggacctgcccatttggtatgactgtactgttgttattaccgaacccattctgtttgcatcttgggagctgttttgttgtcgttcatggccatgcaagaaatgaaataacatgccaaatgtacggctgagggctgacaacactaggaatattgttaaacaggaacactgagtttcttgtgaggatgtcatgatagcttttctg

SEQ ID NO: 80554 - DNA, 380 bp, Zea mays
  Clone ID: LIB3088-006-Q1-K1-H1
cccacgcgtccgcccacgcgtccgagagaatgagagctattttactctacgggacttaaaacggtgtaaactctcaggaaatatattcaatattcttttcaatctgaacaagttcatggcatttgaaactcgtgatccattcctcattcgccaggaacgtgaaaatccaacgctgactgagtgggatcggtttgcgcatagagaatatattagattgtccatggaagaagatggtgaagatgcttcaaatggaagtggtgatgtgtgggacgaatcacttgaggctccattctgaatggtatcttgctgcacgaatttggttgaacatgggtgattatggttgtgaagcggaagaattgtgaagtctggggctacagtgc

SEQ ID NO: 80555 - DNA, 363 bp, Zea mays
  Clone ID: LIB3088-006-Q1-K1-H10
cacgccgtgatggagccgttcgtgatcgccaccaaccggcagctcagcgtgacgcaccccgtgcacaagctcctgctgccgcactaccgtgacaccatgaacatcaactccaacgcgcgccagatgctcgtcaacgccggcggcatcttcgagaccaccgtcttcccgcgccagtacgcgttcgagatgtcctccgtcatctacaaggactggaacttcacagagcaggctctccctgacgacctaatcaagagaggcatggcggtcgcagacccgtcgagcccgtacaaggtacggctgctggtggaggactacccgtacgcgtcggacgggctggccatctggcacgccatcgagcagtgg

SEQ ID NO: 80556 - DNA, 331 bp, Zea mays
  Clone ID: LIB3088-006-Q1-K1-H11
cccggtcgaccacgcgtccgcacactcttatggagacgcccgggatcgcgagtaaccggcagctcatccttacacggcccgggcacaagctcctggtggggtggtactgtgacaccattaacatgaactccaacgcgcgccagatgcttgtcaacgcctgctgattcttagagaccaccgtctttctgtgcctagtcgcttatgagatgtcctcggtcatctacaacgagctggaacttcacagaggaggttttgcctgactacctaatcaagagagacatggccgtggaagacttcttgagcccgtacaaggtactgctgctggaggagg

SEQ ID NO: 80557 - DNA, 318 bp, Zea mays
  Clone ID: LIB3088-006-Q1-K1-H2
cgacaacttcgcgctcgcccacgtcaaggagtggtctctgaagcctctcccgggcggctcggcgccgcagtgcgacggtcaacatttcggccaccgcgttcgtgctgtccacgggcgggttcaccggcaacccgttccacgactacacggacgtgctcatcccggccttcatcacggcgcacccgctccgcggcgaggttcagttcctggtgagcatctacaagtcgtggtggatgaaccgctacatccagatcttccagcagatgatccggcacgaggtggtggacatcgacgcggacgactaggtccggtgctacc

SEQ ID NO: 80558 - DNA, 372 bp, Zea mays
  Clone ID: LIB3088-006-Q1-K1-H3
cccacgcgtccgaggacgcgtggggtccgatcgatgcacctggggctctgcgctctcatgactgctggattagtaacaatcctatacacaccttctgagtatgagcatcagtcgcaatcaagctcatggctagacacaggggggatatgggaaaagaggagctctgatccctgatatgaatcttatgctaacattcagggggacgatgtatatgaaacaatccaaaatctgaatgcaggtgaacagaagctcattgtatggactcctgaatattaacaggactgagctcgacgctaggacacacatgctgccagaacgtgagtcctcaatcataaagctggagcatgccaaagaaagcattacctggcaaac

SEQ ID NO: 80559 - DNA, 346 bp, Zea mays
  Clone ID: LIB3088-006-Q1-K1-H4
accacacatactgggacgcgggtgactctgcggtcgaagccaccgacgacggtaagggactgcgcatgcctgtgatcaaggaacggaaccacgacgggacgctagacttctggctcataaggaaggtcaccaggcccttgaagctgaacaaggacatcaacgctctgtaccatgagggcgcctacatggtcactgccagctacttcaacaacggggacaaaatcatctacaccgtgcagtcgcaggaacacaccaccacgatcggcgaaagaagcctaccgggtctcgcataggctgcacgcactactccatgctccgtacatcctcgagagatctgagagagacc

SEQ ID NO: 80560 - DNA, 407 bp, Zea mays
  Clone ID: LIB3088-006-Q1-K1-H5
ggaatttagcacaggccctctgtcagtactaatgatgagtgttaagaacaacacccaggttctcatcaattgccgcaacaacaagaagctgcttggccgggttcgtgcttttgatcgccactgtaacatggtgctcgagaacgtgcgggagatgtggacagaggtccccaagactggcaagggcaaaaagaaggctctgcctgtgaacaaggatagattcatcagcaagatgttcctcaggggcgactcggtcatcatcgtgctgaggaaccccaagtgaccgcccaaccggaagccaggtctctgttgaaaactgtagcttatgatgtatgttggggatgattaaggccttgttcgtttacgtcggattgcaaccggaattattccagcttattcaaagttatatt

SEQ ID NO: 80561 - DNA, 372 bp, Zea mays
  Clone ID: LIB3088-006-Q1-K1-H6
gggagctaactgacttgctgtaccacaagcaaacacaattagaatccatggccagcgaaaaggccggattggagttccaactggagaaatcattgaaacaatttcgtgaagtgcaggtcgaagcagaaaggaataaagctactcgcagatcagcatcgtcgtgggaagaagatactgatatcaaggcattagagcctcttcctctacatcatcggcacatggcaacagcaaatcatcagttacaaaaggctgcgaagcttttagatacaggcgctgttcgtgcaacaagatttttgtggcgacaccccgttgcacgagtcagcgtgctattctatctggtgttcgtgcatttgttcttgatgcacttgttac

SEQ ID NO: 80562 - DNA, 399 bp, Zea mays
  Clone ID: LIB3088-006-Q1-K1-H7
cttcaagtacaagctgctgcgggaacctggacagcgtgatggagctgcattatggaagatgactcagagatggatagataatcctgctaccagaggcagggtcctactagctgatctgtcatctaaggctgaaattttgcctgtttgtcttgtcaatgaggtagaccatgagaaaggacctgtacatttcacttatactaatcaggtcaaatacttgaggcctctcagttctatgaaaaagttgcagggctgtggatgccagagcgtttgcttgcctggcgacgccagttgtgcttgtggacaacataatggaggcgatttacccttcagttcatcaggattgttgtcatgccgcaaaccaatagtctacgaatgtggtgaatcttgcaactgttctac

SEQ ID NO: 80563 - DNA, 374 bp, Zea mays
  Clone ID: LIB3088-006-Q1-K1-H8
gctgcgtccaccagcctcgtcgttaggacgtaaggtaagacacccaggggcgagccagtgagtacagagagtagccttacgtagcgaagctcagagcaagcgagggtacggtcaaggggggtgatggcgctgtctcgacgcatggcggctcccgtcctcgtcctcatgctcctcctcgtcgccacagagctggggacgaccaaggtggcggaggcgaggcactgcctgtcgcagagccaccggttcaagggcctgtgcatgagcagcaacaactgcgccaacgtgtgccagaccgagaacttccccggcggcgagtgtaaggcggagggcgccacgcgcaagtgcttctgcaagaagatatgctagtagtagcc

SEQ ID NO: 80564 - DNA, 369 bp, Zea mays
  Clone ID: LIB3088-006-Q1-K1-H9
cggacgcgtgggcaacaagggaagaaattaaatgcatgaacccaaattacacagagtgtaaggtcccacaaatcaaagcacacgcatggcacaaggtattccacaaaaggatgccgccagaagctgttgatctggtctctcggctactccagtactccccaaatctgagatgcactgctatggaggcacttgttcacccattctttgatgagcttcgagatcctaatactcgccttccaaatggtcgctttttgccaccactattcaatttcaagcctcacgaacttaaaggagtcccatcagacattgtcgcgaaattgattccagaacatgcaaagaagcaatgctcctatgttggattgtgaaatg

SEQ ID NO: 80565 - DNA, 414 bp, Zea mays
  unsure at all n locations
  Clone ID: LIB3088-007-Q1-K1-A1
cggacgcgtggggcccgatatgtgccaaaaccgcatcacaaagggaagaagcacactgtgcatagtttgaaggaagagtatgagaaaaaacgtgctgaggaggagaaggctaaggaagagcgtgatgcaatggttcaggcaaagagggagcaccgggagaagtctgaggcgaagcggaaagaactgagggagaagatgttcaagaagacaagatctggccaacctgtgatgagataccggatcgagcatctcttggagactgcactgagcaagtaacacgatacgtcgataccaacctcgccttttgagaccaaagtgtgctaccaaattttgtagctccgtgcaaccatttgtttactgtaaccgtcttttgtcgcttcatcgntgtacatatctttggatttgntgatcata

SEQ ID NO: 80566 - DNA, 226 bp, Zea mays
  Clone ID: LIB3088-007-Q1-K1-A10
cccacgcgtccgcccacgcgtccggcggcgcaatgttgagcaagatatatcaacgatgcgctttgtctgcattcaaaggattcatctattgatgtcacaagcctatgaaaactggcgagtgtgaatcctgatctacgactccctgcgatcataatcctgtgactgctggttagtgtcaaatgcagtctgttaaacttcttgatgcggtcactaatacaagttcatc

SEQ ID NO: 80567 - DNA, 240 bp, Zea mays
  Clone ID: LIB3088-007-Q1-K1-A11
aaaaaacataaaaaaacacaaaaaaaaaattaaaaaaaaaacaaaatatataagggaagacctatatatgaattaaaaggagttattctatcgatgtcacaagcctatagaaaactgacaagtgtcagtcttgatctacgactccctgcgatcatactcctgtgactgctggttagtgtctaatgcagcctgtcaaacttcttgatgcccccactaatacaaggtcatgactctggaaaa

SEQ ID NO: 80568 - DNA, 369 bp, Zea mays
  Clone ID: LIB3088-007-Q1-K1-A12
atcgcaccggtcgtagcggttggcccaggccccctggacgaggacggcgagaggctcgcgctgtccgtctccgcggggagcactgtcctgtactccaagtacgccggcagcgagttcaagggcgccgacggcacgaactacatcgtgctgatggcgtcggatctgatggccgatctctcctgaactgagctagagctggaggacgaacgaagtgcaagtgcaagagcaagcttagcaataccgtacgattcctcgcggctctcccgtcccctgccccctcctacttggctagattgtttgactgtattctgaagaacctgacaacaggcatgagcacaccgatgccaggcatacaaaacttatgataac

SEQ ID NO: 80569 - DNA, 414 bp, Zea mays
  Clone ID: LIB3088-007-Q1-K1-A2
cccacgcgtccggaaaaatatgtgccaaatccgcatcacaaagggaagaagcacactgtgcatagttggaaagaagagtatgagaaaaaacgtgctgaggatgagaatgctaaggaagagcgtgatgcaatggttcaggcaaagagggagcaccgggagaagtctgaggcgaagcggaaagaactgagggagatgatgttcaagaagacaagatctggccaacctgtgatgagataccggatcgagcatctcttggagactgcactgagcaagtaacacgatacgtcgataccaacctcgcattttgagaccaaagtgtgctaccaaattgtgtagctccgtgcaaccatttgtttactggaaccgtcttttgtcgcttcatcgatgtacatatctttggattcgttgatcata

SEQ ID NO: 80570 - DNA, 428 bp, Zea mays
  Clone ID: LIB3088-007-Q1-K1-A3
gatgataatgagattgttgatgcagaatgctactctttatgcatgtccattctggaataagcattaaaagctgtctttcagaaaataccaatttcagtaagtactttaaatcggcagcatgcacattccagtccttgtgtatactatcattactttatagcttgttgcatggactaagcacttaagataaaaaattacgatggcttatctgaagaatttgatgtgttcaaggaaaaagaagaatttgatgtgttgtgcattttgaaaagacatatttcatgcagtgcttatcaagagcccttcgggatgagaatccaaaatttctgatggcagcatcaaccttgctcctaccatttcaacccctgatggtttcagctgtccacaccgggataatggaggtttcatttgctaaacgagcatcaatagat

SEQ ID NO: 80571 - DNA, 376 bp, Zea mays
  Clone ID: LIB3088-006-Q1-K1-G7
cagcaacaacatcgtctccggcctccgctacaccaacaccgtctggaagacggggctcaaagttgacagagccaaggagatgctcggcacgttcagcccccagctggagccctacacgtacgtgacgccggaggacaccaccccgtcgggaatgtttgcccgggggtcctactctgccaggaccaagttcctcgacgacgaccgcaagtgctacctggagatcaactacaccttcgacatccgccgggagtggccgtcgacgagctgaccatccttccctccctccatcggtggcctgagcagaccagtcgtttcgttctgagttcttccttttctgtgttgcctcgtcctgtcctgtcctgtccctaggtttttt

SEQ ID NO: 80572 - DNA, 179 bp, Zea mays
  Clone ID: LIB3088-006-Q1-K1-E5
gagagatgtcaacctgccatggtgtcacggtccgccatcagttgaacgtcttgcctgcacttcagtaggccatttttcatggttctagttgtatttgaatccagcgtttgccactaagataaatcagacattcgttttgtgaacctattatgatggagctttatttgctgataatatct

SEQ ID NO: 80573 - DNA, 360 bp, Zea mays
  unsure at all n locations
  Clone ID: LIB3088-006-Q1-K1-E7
cgtcggtctcagcgctgcaaccgttcgctcgcctcaaggctaacgacggcgctccgagtgctcctgggcgcggaggcggcggcggcggcngcgtgtcttcgaggccggctctgaagacggaccagttcctccgcaccgtcgcgccacagcatcatcggcaggaagtgcagttcctttcctccgaccataagaagcctcagccccggccggctcctggaccaccccttattggcgcagaggtccatgggacgatcgatggagctttcgattccgggtacctcatgacggccgtcgtgaatgggcagctcttcagaggcgttctgtttgctccgggacctggggttacggctccgagaccga

SEQ ID NO: 80574 - DNA, 124 bp, Zea mays
  unsure at all n locations
  Clone ID: LIB3088-006-Q1-K1-E8
cggacgcgtgggtgaaaacggaaagtgaagttcttatnaaaaaaaaaaaaaaaaagagaaaaaaaaaaaaaaaaaaggggaaaaaaaaaaaaaaaaataaaaaaaaaaaaggggaaaataaaaa

SEQ ID NO: 80575 - DNA, 386 bp, Zea mays
  Clone ID: LIB3088-006-Q1-K1-E9
cggacgcgtgggcggacgcgtgggattttgacaaggatcatagcgggcacattacagttgatgagttggaagaagctttgaagaagtatgatatgggcgatgaggcaacagttaaagaaattattgctgaagtagacacagatcacgatgggagaatcaactaccaggagtttgttgccatgatgaagaataatagccccgagattgttccaaatcggaggcgcatgttttaaggctcatctcctacatttaattggaaaaaagaaagacttctaagatatatttttccgcggtcagaggggagagcaactgatactcgaaagtgggattcagcctgggcatatgtgcaatgatattacagactttggacaagtcatcagtcatgg

SEQ ID NO: 80576 - DNA, 352 bp, Zea mays
  Clone ID: LIB3088-006-Q1-K1-F1
attttgctgccaaaaaaaaataaaaataaaaaaaaaaaaaaaaaaaaaaaagggaaatgaataaaaaaaaaaggggaagtaaataaaaaaaaataaaaaaaaaataaggtctaccttaataaaaaaatccggtcttcctttctcggggtgtcctgccttctttccctcttctttcctacctccttattttcttttcattgccccctttttccttactccccccctgttaaaccccttgccttcctttaataaccctccttttcccccatccatctttctttcatatatttttcctctttcacccccccccctttctccattctcccctttctttctcctctttttccttttt

SEQ ID NO: 80577 - DNA, 353 bp, Zea mays
  Clone ID: LIB3088-006-Q1-K1-F10
gttctagatcgcgagcggtcgcccttttttttttttttttttttttttttttttttgttttgttttttttttgggggggccggcaagcttgcgcgctacaacaagaagcccaccatcaccttccgcgagatccaaacctccgtgcgcctcgtgctccccggggagctcgtcaagcacgccgtttttgagggcaccaaggccgtcaccaagttcaccttcttctaggcttgcacgctcgccctttgtaggcttctcttgggttgatgttccccttgagttgtaactagatgttgcttggttatttgtcggcgctgctcttcttttgtaagaactgcgtcatgtaacccaccaag

SEQ ID NO: 80578 - DNA, 383 bp, Zea mays
  Clone ID: LIB3088-006-Q1-K1-F11
cgggcttcttcgccagctggtgagcattcggagcccaaacaatcgatcaaataaatcaaattaaatctagtcgctgttgcctgctttttgatttcacttgattccttctctggtggtacgtgatggctctccgtttcttgtatgcatgtatgtatgtatcatcacagttgtgggtgcttctctggcggcgaaaccgcgagatagatagattcagtgttggaccgagaaccatggatggatggatggaacatgcatgcccagtgattgtttgcgccggtgaaagttcaatttgtccggatttattttctctgaaatagtatatgtttttttttctccatcggtgagccggtgatcttgtcaatttgtacaataatcattatatg

SEQ ID NO: 80579 - DNA, 371 bp, Zea mays
  Clone ID: LIB3088-006-Q1-K1-F12
aggccatccaaacagcaccatggatcgttgtatagtcctggatccttcaagggacgccagcaaggtagcaaatttggtggcagtactacaagttggagttctgttggcagcatatttggtactatcgacttgagtggcaatcaacaaaggggcagcatgccatttggtagtcacaatggctctctggagtttatgaattagcaaaaccatgggccacgcgctacaaaatcgaagatacaaggcacagagaacacctcaggagatgagagaagcgagaaaattgttcctctgattgatagcgaactgtacaatcactctgattttataaccgagtacaaagatgccaaattctttgtaataaagtcctacac

SEQ ID NO: 80580 - DNA, 403 bp, Zea mays
  Clone ID: LIB3088-006-Q1-K1-F3
ggcagaagaagctgatgatggcatgcatcctggaaacgagcagtggctgtggccattgactggtcaggtgttctggcctggtattgctgatcgggaaagggaggagaaatacattaaaaagctggataagaagctcaagaacaaggtgaagttacttgaaaggcagaagtctggttacaagcagaagcccctgggacaatgaccatgactgaagagctaacaattcaagatttttttccttgccacgtccggtgcatgcatgtggaagagttggagcacaaaaggcaccgctgttgtgaatacgcattctttctacgcctcattgatctccctctccaaagatgtttggtgagtctggaggatattgtcaggatggaaaagcaccaattttttcctgttcgta

SEQ ID NO: 80581 - DNA, 200 bp, Zea mays
  Clone ID: LIB3088-006-Q1-K1-F4
gcgatacagagatatcagtgcactcgaggggagcatttgacaagtgcaacggagaagttgggagttttggtgaggaagagcttgctcatcatcatggttattggactctttactggcggtgatatatataatatatgtatgtataaaaaaaaaaaataaaaaaataaaaataataatatataaaaaaaaattattaattt

SEQ ID NO: 80582 - DNA, 415 bp, Zea mays
  Clone ID: LIB3088-006-Q1-K1-F6
aaagaaggagaagacggtgaagaagaggctgactttgccagagaagatgagattgaggagcaagaggttatgcaagctcagaatgagctttgtcaagaagcccaagcgtcgaatgctccgggtttaagcataattttggtttggttggagcggatgatcatgggagcggacaccaccagatccagttatatctcggaagatcagaaaattgtagtcccttaactgtgcctgcccttgtgagtgactatgcaacatcatttttcgaaggcgagagctatgtatggtttctttttttttacttttttttggttgatgccctggcgactccggtgatgtttgatgcaacaccttgcattccattatagcacaataacgcaccattttactgaattttaattacacttggggggagggt

SEQ ID NO: 80583 - DNA, 275 bp, Zea mays
  Clone ID: LIB3088-006-Q1-K1-F7
cccacgcgtccgcggacgcgtgggtggaaaatgagcgattggagctggagctgaagcttaaggaaattgagataggcatcaaaccaaagaggatttagagattgcaggatgcaagtggtagagctagggaacttttagagtttctggtaaccattttatctattgtagtaccttacaaattaggatatgttacatagtttcatcttcgctaactgcatatcagttaagttaataactctgttggtttcaagcatttgcaataagtacagtttacc

SEQ ID NO: 80584 - DNA, 394 bp, Zea mays
  Clone ID: LIB3088-006-Q1-K1-F8
agcgcctggtgcgtgagatcgcccaggatttcaagaccgaccttcgcttccagagctccgccgtcgccgcgctgcaggaggcgtccgaggcctaccttgtcgggctcttcgaggacaccaacctctgcgccattcacgccaagcgcgtcaccatcatgcccaaggacatccagctcgcccgccgcatccgtggggagagggcctaggcgtcgtcgcggtggaggtggaagtagtagtcgcagtttctgtcatcactgtctggctagaagttgtagagatgtgccggtttatgtagtttgggttattggtcgaatcattatgtagttgggtcttcactgctgtaatttaactatgactatgcaatggcaatgaagttctcggttatcacttcccg

SEQ ID NO: 80585 - DNA, 393 bp, Zea mays
  Clone ID: LIB3088-006-Q1-K1-F9
gcgcagccccactcagatcctaacaccatcaagcagattttagctcagcaggtaacctctccggtgcaatgggaaaccactgttaagaatcttatgggcaaggggcttgagaaaagttatgaactcggacctggaaaggttatagcaggtattctcaagaggatcaacaaaggcactagcattgagaacatcggggcttaaacgtctgggatctgaagaactcttgatggaaccaagttacacagcagaggattgaaacatgccattattgtggaacgatgtttccactcagagttaccgtttttttaccttagtggttgaattttgatcttgatgtaaaattgacatgaaacacatatggttaatgattttatgaacagtgtaattttcaca

SEQ ID NO: 80586 - DNA, 78 bp, Zea mays
  Clone ID: LIB3088-006-Q1-K1-G1
gtcctgtattagttaagctggacttgctcgaataaaaatgaaaaaataacgggaaggaaaacatgaaagaaggcaggg

SEQ ID NO: 80587 - DNA, 239 bp, Zea mays
  Clone ID: LIB3088-006-Q1-K1-E4
cccacgcgtccgcccacgcgtccgtccacgcgtccgcccacgcgtccggcacggatgtggatgagcggtggtgtattgtaattgtaaagagggctgaaagaaaggtccctctggttgggcgtgtcaccaaagagtggccctagaggcaaaccttacgtttgctcgttgcccttggtgtgtacccagatgtgtatcgatgacataggctggctgctgtatcatcatcagggttgacgctg

SEQ ID NO: 80588 - DNA, 352 bp, Zea mays
  Clone ID: LIB3088-006-Q1-K1-G11
cccacgcgtccgacaagaacaagatcacacagtcaaaaggtgctacttactatacacgcacaaaaaacatcgaccaggatggcatctccaacccgtcaggcaccggcaccggcaccggcaccagcaccgccaccgttcctcgttactcccatcatgctgatgctgtggctgctgctcgcttcatcgcacacgcgcggcgccatggccgcgccgcccaacacggaggcgctctcggtgctgtgcaatggcgcgtcctacggcgccggggaccccttcgcgacgagcctggcgttcgtgctgtcggagctggtgtccgccacgccggtccgggcaggccacgacttctacgaca

SEQ ID NO: 80589 - DNA, 309 bp, Zea mays
  Clone ID: LIB3088-006-Q1-K1-G12
gttatcaggaactggtcgacacttgacaagtacccttcctgcgaaactatcaaaggagacgttttgctggagatgatactcatgcggtatgcggacagcggcgagacggctctgttggaggtgtttggtcttatgtcctacacctgcgtcgaggtgatctaggagctggttgaagagacggttgatgctctactgactgactgctaacgagtgatacttgctgctgatgctaacactgctcccataatacactcctaaagctgggatgggtgtctttgccttggtcacattttttgtttcgaccggcat

SEQ ID NO: 80590 - DNA, 360 bp, Zea mays
  Clone ID: LIB3088-006-Q1-K1-G5
cggacgcgtggggatttggagaaggcaagagaaatattaactgtgctgcatgagcagttaaatgctgtcattcatctagagtcaatttttccatgcgaaaagcgtattgattttttagactcacttgtggagaagtttgttacacctgaatcatctcagggagaggtggcaagtctagttgacaaagaggaaatatcttccatatttttagagtttttggatctctttggggctgttggaataagtgatattttagagtagttaatactagtagctagggtcaggatttacatgtttatttgcaatatgtcgacgccaaaggattcggtctttatactgataataaaccgctattgattt

SEQ ID NO: 80591 - DNA, 351 bp, Zea mays
  Clone ID: LIB3088-006-Q1-K1-G6
ccaacgcatcagaattagctttaatgttctagaaaatctacttattatactgcaccagttaaatgctgtgattgctgtgaaatcaattctttcatgcgaaaagcgtattgattttttacactcacttttggataagtttgttacacctgaatcatttcagggagaggtgtcaagtctacttgacaaagaggaaatatcttccatatttttagagtttttggttctctttggggctgttggaataatttatattttatagtagttactactaatatctaaggtcaggatttacatgtttatttacaatattgtctatctcaaacgattcctgcctttatacttgataataaa

SEQ ID NO: 80592 - DNA, 78 bp, Zea mays
  Clone ID: LIB3088-036-Q1-K1-H12
cccggccgacccactcgtccgcatgcgctcgacaacacatcaacaacagctacacattaacccaaaatacacctatac

SEQ ID NO: 80593 - DNA, 198 bp, Zea mays
  Clone ID: LIB3088-036-Q1-K1-H2
taaaccctagccgccatatctcacgatcctctctagcaccaagccgagggaaggtgaagagcgatttcgcgcggcgtggtgtcggcgattggctgcgcggtcgcgggcaagaagaaggggtcggtttccttaacgatcgactgcaccatgccagtgtaggacaagatcttgaaggtcgcctcgttcgagaagttcttg

SEQ ID NO: 80594 - DNA, 225 bp, Zea mays
  Clone ID: LIB3088-036-Q1-K1-H3
gagcccgagcaaacaagggtggacgcggattcgtggcggatcggagatggcggagaaggagcgaggcgccggcactcgcaaggatgaggtggtgacacgcgagtacaccatcaacctccacaaacgcctccacggatgcaccttcaagaagaaggcaccaaatgccatcaaggagatcaggaagttcgctcagaaagccatgggtactactgatgtccggattga

SEQ ID NO: 80595 - DNA, 208 bp, Zea mays
  Clone ID: LIB3088-036-Q1-K1-H4
cccaaaaccaatggcgcccttgtgaaatgagtagccttggaagggacaggaggaaaacttgtagattccattagcagtttagcacccaaaaccaatggtggtctctgctcacagttccattaattgctagttgaacgggttcgttggagcccacaattaggttggttccctgtgagtaatttgggtaatcattaagacattctcgtac

SEQ ID NO: 80596 - DNA, 148 bp, Zea mays
  Clone ID: LIB3088-036-Q1-K1-H5
acccactcgtccgccgaggcgccccaacacccgagaactaccctcccagcacccaaaaccacagccacaggaagagacatttgaagccacggaaggcacacacaataaaaccagcaaagcccacaaccacaagagcccccaaaaccaa

SEQ ID NO: 80597 - DNA, 419 bp, Zea mays
  Clone ID: LIB3088-036-Q1-K1-H6
gtccgcggacgcgtgggcggacgcgtgggtgagtagagctgccctccttggagaagatgagaggccgcttcatgcagcagcttgaaatgctgcgcccggatcacatccggcggctaaatccaacgccctacaaggtgagcgtgagcaccaagctgtacgatttcatccaccgcctatggctgaacgaggcgccagtaggtgaactgcagtagatgatgatcatataaaagaagtcttgggtcatctgcgatacagcagcaattcatcgaagaaaattagagctcttctgcacaacatcaacagttgagcccatggcaggattttgctccccaacttttcatctctaggcaccgggatagaggcaggttaatcaggttggctagtttatacgtcccttaattggggggatgctatacaca

SEQ ID NO: 80598 - DNA, 70 bp, Zea mays
  Clone ID: LIB3088-036-Q1-K1-H7
atcacatccggcggctaaatccaacgccctacaaggtgagcataaagcaccaagctgaacaatttaatcc

SEQ ID NO: 80599 - DNA, 342 bp, Zea mays
  Clone ID: LIB3088-036-Q1-K1-H8
gtgcggcagggcacagcatacaccgcgaatttcgattccggcccgctcccaaacccgaccgagcagagcgcatagccccccaacctcagatcaatccgcagcatcgatggcgcccaaggcggagaaaaagccggcggcgaagaagcccgaggaggaggagcccgcgacggagaaggcggagaaggctccggcagggaagaagccgaaggcggagaagcgcctccccgcgggcaagtccggcgccggcgagggcaagacgggcatgaagaaagccatgaagagcgtggagacctacaagatctacatcttcaaggtgctcaagcaggtgcaccccgacattgg

SEQ ID NO: 80600 - DNA, 245 bp, Zea mays
  Clone ID: LIB3088-036-Q1-K1-H9
ctggaccttcagaccgtcttacgaccgagtcgatccaagcactgaaacatgcatgaatgttgggtttactcacgcgtatgggatccatgggcaatctaatatagacattagcgtggcatgaccaaggaccaatcgcgagcctctgctcacacgaccactaatgccaaaacacacgggtacgtaggagcctcacataagggcggttccttgtgagtaatttatgtatatcattaatacattctcgt

SEQ ID NO: 80601 - DNA, 184 bp, Zea mays
  unsure at all n locations
  Clone ID: LIB3088-037-Q1-K1-A1
ggcggccaagctgtggaaacgagggagacgaggaggacaagggaaagaaagcctaccggcgtcggggctccggctcacctcggacanccccaaaaaaaatctcgcgtggccgccggcggccaccaccataactgccatgatcagcatcctcgcgcaggaccgcctcctcgggttcgccctgggt

SEQ ID NO: 80602 - DNA, 476 bp, Zea mays
  Clone ID: LIB3088-037-Q1-K1-A11
cgcctgctgtacctgtccttattcccgttcgtccccgcgtccgcccggtttggctgtagcatgttgtgagatgagaaggctattttgtcaaaaaaaaggggggggaaaataaaaaaggagggggggaaaaatataaaaaataaaaatattattaaatggggggggttttaatattatccaatatttatttaacggtaattcaaaattatttactttcttttttaaacccttaattctattaattccccctctttttccaactttttggcctcggatttccttgtgtttcccacctttttcccctttcaacactttcccttttttttttttttccctttaatctaattcccccccccggttttttattaccaacttttttgaaacccctttttccccccttatttatccttttttacccctttttccttttccgtttttgttttttttacataattttccccctttttttttctttt

SEQ ID NO: 80603 - DNA, 379 bp, Zea mays
  unsure at all n locations
  Clone ID: LIB3088-037-Q1-K1-A12
gccacgcttnctaaaacatattattatattcataagactatctaatcaaaattaaagaaggggttaataaaaaagaaggggggggccgctattaataatccaaacttacatacccgttcatacaaatatttagctcttcaatagtgtcacttaaatttaattaatttgccttctttttacaacttcattactttaaaaaccttttctttaccaaaattaataacctttcaacacattctcttttctccagttgtcatattaacaaaaaggcccacaccattctccctttctaaaaattttcacatccttaatggctatatttactccccctttaccttcactttaatccctataattttttttgtttactctcattttt

SEQ ID NO: 80604 - DNA, 316 bp, Zea mays
  Clone ID: LIB3088-037-Q1-K1-A2
acgaactggctgccgcatggaacgtgctgactccgataatccatgagatagatcagaacggagtagttcctgagctctacgaggctggggacagatggcctatcaatgcttaccatcttgctgctaaacatggggtgcgatgggatgacgactggtgagtcgatacatggcaaagattctcgatgcgcaacgagattcattaccaatttttgtcgttgtatcgcagtcagctgtacaatatgccttctgtaatcggcctgatcaatgactttcaaggagacatgtaaacatggtttctttcctgtcctggtaactg

SEQ ID NO: 80605 - DNA, 367 bp, Zea mays
  Clone ID: LIB3088-037-Q1-K1-A3
gagaacctgtcaaagatagaacatgttcccagcactcaattccatgacagaccgtcagacgctgaagctccagaggagaaagaggaggacatggacaagaggccacctcagcgcagcagattatggagcggaggagcttacgactctgatacagaggatcctgacagcctgaaaagcgagggtaaagacgtaactgctaacttccagatgaaggatgaaccaaaagatgatctgtagaagtttcagaagtgcccccaaagttactgagttgtcaatgggatcgtcgacatgcatgttgaagagtggggacgcatctgaacctgtccgtgctgatatctgccgctgtgcatctgtaacagactgaacg

SEQ ID NO: 80606 - DNA, 299 bp, Zea mays
  Clone ID: LIB3088-037-Q1-K1-A4
tcgtccacgcgttcgtccacgcgttcgcccacgcgtccgcaattgtcacattgaagccaaggacgatccaagcataaaaaaaaaaaggaaaaaaaaaaaaaaaaaaaaaaaaaaaaaaaaaaaaaaaaaaaaaaaaaaggtataaaaaaaaaaaaaaaaaaaaaataaagaatgaggggaagaaaaataataaaatatggggggggggttttttaaattagtaagcttgtttataattttaaaaagtgggaaaattgtttttttttggggcttaaaaattatttgggggggggggattt

SEQ ID NO: 80607 - DNA, 187 bp, Zea mays
  Clone ID: LIB3088-037-Q1-K1-A5
aaaaaaaaaaaaaaaaaaaaaaaaaaaaaaaaaaaaaaaaaaaaaacattataaaaaaaagggagggaactataaaaaaggggggacgggcgtaacttttctatagcctccccttctttcatttggcttcccctctttttatatccttgctactggttaaacactttcaccaccttaattattcttt

SEQ ID NO: 80608 - DNA, 423 bp, Zea mays
  Clone ID: LIB3088-037-Q1-K1-A6
ggtgtggtcactcgttggggtgtcacccggcttccccgcaagacccacaggggtctccgcgaaggtgcttgtatcggtgcatggcatccggctagggtctcctatacggttgcccgtgctggtcaaaatgggtaccaccaccgcactgagatgaacaagaaggtttacaagatcggcaaggctggacaagagacccacgatgcctccacagagtttgacaggactgagaaggacatcactcccatgggtggcttcccccattatggtatcgtgaagggtgactacctgatgatcaagggctgctgtgtgggtccaaagaagagggtggtgaccctccgccagtccctcctgaagcagactttccggctggcgcttgaggagatcaagctcaagttcatcgacacatcatccaaatttgggcac

SEQ ID NO: 80609 - DNA, 344 bp, Zea mays
  Clone ID: LIB3088-036-Q1-K1-H11
cccactcgtccgcctgggcacgccaacacgggaagaaaggaatagttatgaacccaaattacacagagtttaggtcgcttctaatcagatcacaggcatgccataaggtattccacaaaaggatgccgccagaagctgttgatctggtctctcggctactccagtactccccaaatctgagatgcactgctatggaggcacttgttcacccattctttgatgagcttcgagatcctaatactcgccttccaaatggtcgccttttgccaccactaattaatttcaagccttaacgacttaaaggagtcccattaaacattgtctcgaaattgatttcagtactt

SEQ ID NO: 80610 - DNA, 281 bp, Zea mays
  unsure at all n locations
  Clone ID: LIB3088-037-Q1-K1-A7
ctcttttgtacataaaaattcatgatgttataaggtaagaacaatatatttacattgggngggtccaaatcacatgcgggacggcaaaaaaaatctctctttccttcagctgtcactaccataactggcgtgatcagcattctcgctcaggagcgcctcctcgggttcaccctgggttccgcctacatagacaagattcgtactctaccatcgccgtgccatctaccgttaaatctctgaatccaacgggtcgccctacttttaccaacctggtgaaattg

SEQ ID NO: 80611 - DNA, 428 bp, Zea mays
  unsure at all n locations
  Clone ID: LIB3088-037-Q1-K1-A8
cggacgcgtggggtggactgggacaacattaactggtcaactagaaggccacagatggatttccctgtgcagtctgctatctgtacactggaagatgtagatgttatcaaggaaggacaggctaggattgctggatatgcactttcaggtggtggccgtggcattgagagagtggatgtatcagctgatgggggtaagacctgggtcgaggctcgtagataccagaaagacaatgtggcgtatgtgtcagatggacctcaaagtgataagtgggcttgggttctctttgaggccacattagacgtaccagcgaatcctgagatcgtagttaaggcggtggactcagctgcanacgttcagcccgagaaggtagaagacatatggaatctgaggggaatcctcaacacgtcttggcatcggatcaaaat

SEQ ID NO: 80612 - DNA, 427 bp, Zea mays
  unsure at all n locations
  Clone ID: LIB3088-037-Q1-K1-A9
cccacgcgtccgaaaacagttgactatggtcgaggaggatcaccgtcagataaaagcagtgcttcagaagtaagaactcatgttcggccactggatgctagcacagcagcccacgtggcaggtccctcaagtaacaggcgagctacagttgtgcctgaagaggtttcagatgaaggagtgttccgtcgctttgtcagactacttctggccttcattgtcaaagtctttgccttctttcacatagtacgtagtcagcaggaaacgagggtcaacaacctactacctcctgccgaaccagaactgatttctgacgatcatccggcagtagagactttcaatgtagaccacatcagtcctgtcattagagcgccttcagagacttgaanggaaggtcgatgagcttggcagcaagcctccagcgattcct

SEQ ID NO: 80613 - DNA, 288 bp, Zea mays
  Clone ID: LIB3088-037-Q1-K1-B1
gcgcccacgcgtccgcccacgcgtacgcccactcgtccgcccgattgtggagaagaggttagcgcgaggctggaatcagattggcggtggtacttaatcggatatttggtggaggtgaagcggatgatataccactacaagtacagtaacagctctaataaaaggaagcatagctattacaaggatttgtccattacgtcgtctatacatcaataaattggcatgaatttgtaactccattgctatacatcaataaattggcatgaatttgtaacaattgaaaggatc

SEQ ID NO: 80614 - DNA, 155 bp, Zea mays
  unsure at all n locations
  Clone ID: LIB3088-036-Q1-K1-E1
gacccactcgtccgccaagacaatatgcaatactgcagtatcccagcctcnttgagctgctgctaaccaatgaaccacagaaggctttagttaaccacattcccaacgaaagttgactgaacccaaccacctttgccgaatttcctaaaccattt

SEQ ID NO: 80615 - DNA, 163 bp, Zea mays
  Clone ID: LIB3088-036-Q1-K1-E10
gcggccacgctccaactccagatcactctcacctcaacccagacaaaccaatgcaagcctagatacgaccatggacaccacaatcaccgcagcaagaagaaaccaaaaaaacaaagctaccagcatcaaacacctcaacccaaaaaacaagcacaacccacaa

SEQ ID NO: 80616 - DNA, 285 bp, Zea mays
  Clone ID: LIB3088-036-Q1-K1-E3
gtagaagggaactattgaccaaccaatgctggctgtggaactgggcaggcatggcgccagagagctttgcagctccatctggtcgctgttttagagcatctgactagctgttagcgctttccctagtttctctctctccatctctatctataaacttgttccccgttacattttccttatatcccgaagaccctgatgccagagtatagatacaccaaacacctggtgtctgacaatgtaacttctcgtcataccccttacaaagtgactattacagctcttttc

SEQ ID NO: 80617 - DNA, 377 bp, Zea mays
  Clone ID: LIB3088-036-Q1-K1-E4
ccggactcgttcgatcgcgagcggcggccctttttttttttcttctttttttttttttttttgaaaaactcagcacgaacattcaaatgttcagatattcaaattcttcgaaaatgttcagactttagacaaaaagtaactctaatatagcagcttcacacacgcacaggggacaactccgaaactgagtgggcagaagacttaacacggtcgaaaagctaaagcctttgggcgagcatcaaccggtgctggagatggagctgtagcagcagcaccaggaccagggcgggggcctccttgtccaccagcaggcctatcctccctgcgcctgaagcgctccggcggcttgcggtccctgcgcttctcacgggatcgga

SEQ ID NO: 80618 - DNA, 249 bp, Zea mays
  unsure at all n locations
  Clone ID: LIB3088-036-Q1-K1-E5
ggacggcagaatgcaacgtgagtatttcatcagtagtgtgtggagctcaggacctatcatggagcgattcattgcggcttcgtcctgccgctgacgaatagcaactgactcgctggtaacgcttctaccagtttatgtacctccctcctnacctataaacgtgtgcccggttacattttccttatatcccgaagaccctgatgccagaggatagatacgccgaccacgtggtgcctgacaatatgactg

SEQ ID NO: 80619 - DNA, 174 bp, Zea mays
  unsure at all n locations
  Clone ID: LIB3088-036-Q1-K1-E6
atcgcgtgcgtcggcatgagaaattttgttgcatcagcttgtgtcgggtcgnatagtgcggaagctctttttcacgttgcctgtggtgtatcttaatttgcgccgaggccttatgagtgactagtgtttcaactgtaactggattgcacattttcgtcgcatggaatgtactat

SEQ ID NO: 80620 - DNA, 160 bp, Zea mays
  Clone ID: LIB3088-036-Q1-K1-E8
gtagaagattccatcattgcataactcgactagtgttagtagtatatactcttgggcaagattgtttttgtagccatgactcatagtatgtagcagtatggtgatggttggattaattcagcttttttgctcttgcttggtgttcttcaaaaaatttaat

SEQ ID NO: 80621 - DNA, 127 bp, Zea mays
  Clone ID: LIB3088-036-Q1-K1-E9
cccggccgacccactcgtccgatcgcgcgcgtccagcctaaagtgccagttacttacagggtaaggctcgacacaaccggcaggattccagagatggaaaggtgcacacaacattgctaaaagttga

SEQ ID NO: 80622 - DNA, 270 bp, Zea mays
  Clone ID: LIB3088-036-Q1-K1-F10
gcgagggccgccctctaacagttagggggtacattatccgcttgtattattcaaatggtgcccagtacgaccaacagcgaggacaagacaactacgcgaccagaaaggcaggaacacgacgccagagcgcggacagacatgacgcgacggctgcactgcacccgcgcggcatctctccggtccggagcacgcaagcgcaggcggcaggtgtgagacgccgtgccgcctaaccgactggttgctttctatctcctcgcgggtcgatcgttc

SEQ ID NO: 80623 - DNA, 274 bp, Zea mays
  Clone ID: LIB3088-036-Q1-K1-F2
gtggacgtcgctgatgatcccgcccatcgtgatctagatggtgaacctgatcggcatcagtggggggttcagccgcaccatctacagcgtgatcccgcagtggagcaagctgctgggcggcgtcttcttcagcttctgggtgctggcgcacctgtacccgttcgccaagggcctgatggggcggatgggccgcacgccgaccatcgtcttcgtctgggcgggcctcctcttcatcaccatctcgctgcttgtgggtggccatcaacccgccgtc

SEQ ID NO: 80624 - DNA, 283 bp, Zea mays
  unsure at all n locations
  Clone ID: LIB3088-036-Q1-K1-F3
cccacgcgtccgcccacgcgtccggatgccttttttcttgcaacgactactggtagtagacctacttgttgcagttgcgagcggcatgtaaagctgaagcatgtccagtccatttttgtttgatgtaaaacttttatcggctagaattttgaccgggcttagaagaggcagagtatgaggcgtttggatgtcagttcctttcccagggtttaattnctgctagaggtaagttcctatgttggagctctaatgtttatctggttggattccaggatttaaattg

SEQ ID NO: 80625 - DNA, 113 bp, Zea mays
  Clone ID: LIB3088-036-Q1-K1-F5
gactagttctaatcgcgagggccgcccttccatttttttttttttttttttttttgggaagttttttttttatgttttttggtttttttccaacgcgcccgctaaaatcgcaa

SEQ ID NO: 80626 - DNA, 118 bp, Zea mays
  Clone ID: LIB3088-036-Q1-K1-F8
gacccactcgtccggaagcatcataagcgccacaaaaactaaactaaaaacaaaaccaaaaaaaaaaaagaaatgaataaaaaaaaaagaaaacaaggcaaaacaaaaaaacaaacaa

SEQ ID NO: 80627 - DNA, 324 bp, Zea mays
  Clone ID: LIB3088-036-Q1-K1-G10
gaggaaacatcaatacaacttccagaaactggcttcagcaatactattgttcaaggtcaggttgatgtcaatgaacaccgatttgatggaccaagaacaatcgaagaaatcgttccggttccattggatgagatccagatccatgaggatgtcccagggcaaccgggagcagccgatgagatagatgaggtcccattttctgacgctccgatcattggtgctccattcagactgatctcatttgttgctaggtatgtcagcggcgctaatttggtcaaccaaagataactgtctgcataccaggaattcaggacttctatgtca

SEQ ID NO: 80628 - DNA, 299 bp, Zea mays
  Clone ID: LIB3088-036-Q1-K1-D7
cgagttactagcccaagaacattctcaactcctgtgctgctggttttatagcatcgcatgtcaccatctgtctggtgaggagactacccttactacaagattgctgtcctcgacaagctcgattactgctccagcctaaagaacctcaacccctcacgggcttcaccaaatttgaagtttgtcaagggtgacattgcaagtgctgatctggtgaaccaccttctggtcacagagtcgattgacaccatcatgcactttgctgctcagactcatgtatatatttcaattggcaattcatt

SEQ ID NO: 80629 - DNA, 324 bp, Zea mays
  Clone ID: LIB3088-036-Q1-K1-G11
cccacgcgttcgggccgcttctgagggcctactttatggtatcatgggctacgtggagggggagctttttttcaccgacttgaccggtgacagcatgtcgagcatcttctacgccaaggccgggattgccctgaacgaccacttcatcaagctcgtctcgtggtacgacaactagtggggctacagcaaccgcgtcgtcgacctgatccgccacatgttcaagacccagtacgctagtatagagatagatttctgcctccctatcgtgggtcgtccccaatggcctttggtcgcataccatctttgctgctttgttatgcttat

SEQ ID NO: 80630 - DNA, 159 bp, Zea mays
  Clone ID: LIB3088-036-Q1-K1-G5
cccaggcgtccgaaaaaaaaaaaaaattactaaaaaaaaaaaaaaaaaaaaaaaaagggagagaaaataaaaagaaaaaaaaggaaaaaaaaaaaaaaaaaaaaaaaaaaaaaaaaaaaaaaaaaaaaaaaaaacggaacgacgacaagaagaagccac

SEQ ID NO: 80631 - DNA, 303 bp, Zea mays
  Clone ID: LIB3088-036-Q1-K1-G6
gaccgactcgtccgcccgcgcgtccggaaaatccgtatgtgcgcttcatacgattccgagatccgtgcgtcttgtcggctgccatgatgctgcgcgcggcgggcaggcgactcctcggcgtaagaggcggcgatccagcgcccgcggtcgctgctgctgtggcggcgagcaggagcagaggataccacgagcgggtggtggaccactacaacaacccgcgcaacgtggggtccttggacaaggacgacacggacgtcggaacggggatcgtctgcgcgcctgcgtgcggtgacgtcatgaagc

SEQ ID NO: 80632 - DNA, 207 bp, Zea mays
  Clone ID: LIB3088-036-Q1-K1-G7
gcacaggcgttctgcctagacggaagctcgtcctataccatatatacagacgctacggcagaagactttgatgatgctcagcgcgccatgattacggatacacatcgatggaagcaaatgaccaacatatatgatcaaggctctaacgtcgagcagcgtcaacccttgatactctggccatggtgtgggccaacctaacaacggctg

SEQ ID NO: 80633 - DNA, 306 bp, Zea mays
  Clone ID: LIB3088-036-Q1-K1-G8
gccggacgcacgcgtccgcccgcgcacgccgccaagaaggcattccctaagaccaaagctaagccggcaaagggcgagactgccaagaccaccggccggagcgccggccaaggccagccgccgccaagtcaaagaaggcagccaccgccaagccaaagaaggccgctgccgccgggaccaagcgcaaagtgcccgagacgaaggtcggggcgaagccaaagacaggcgccaccggcaaggccaaggccaagccgacgaccgcgaaggccccagcctccaagaaggcacggaaggcctccacatgag

SEQ ID NO: 80634 - DNA, 228 bp, Zea mays
  Clone ID: LIB3088-036-Q1-K1-G9
cccactcgtccgcccagtcgttcggccgagacaccgactacttcgttctcgcatatatatgatagaataggggccggtttcctaggacgtgctgaggtagatgcttctgcggtggcgcctacagacgaaaaggggcagaaaatgcatacctaacatccgctcgttgccctaggtgtgtacccacatgtgtatcgatgacataggcaggctgatgaataatcatcaggg

SEQ ID NO: 80635 - DNA, 199 bp, Zea mays
  Clone ID: LIB3088-036-Q1-K1-H10
cggacgcgtgggacggcattgacaagggctaagcatcgagcacggatacaaggaaaaaggtcgactttacccagcagcatgccagccaggcacaaactagtgaaggacgcacgggaccgaggctgctaccgctaaaccagcgacgatggggatccgacgaatgcatgcataaacgccatcatagatcacaacgatcccg

SEQ ID NO: 80636 - DNA, 257 bp, Zea mays
  Clone ID: LIB3088-036-Q1-K1-A12
ccgaaaagcacgaaaaaaaaaaaaaaaaaaaaaataaataaaaacaaaaaaaaaccaaacaaacagacaggttcaaacaaaaacaaagcccacccaaaaaaaacaccaaaaaaaaaaacaacaaaccaacaaaaaacaaacaaaaaaaacaacacccaacccaaaacgacccacaccaaaacccccaaccaccacacccaaaaacccccaaaaaaccacaaaacacaaaaccccaaaccacaacaccaaaccaacaa

SEQ ID NO: 80637 - DNA, 342 bp, Zea mays
  Clone ID: LIB3088-036-Q1-K1-A2
tcgtgcgagtacaaacctcgctggaagtgctgactagctacctggtaatatccattgttattagccagattaccttccctgaacttggtgctgtaatgacttctccagaagccaaatctgttctgaggttgcggaagacttctgaggaaggcaccaaggatgtcaagcaggagagttgtctcgagccacacttgagagcaccattgcagaagggaggcttccaatcatacatcatctggctggttcttccggtggctctgctcctgcttctctgtgttgggacatatggatgggtatgaaatctatcctggtgccgttcaaggcttgtcattttgctcacat

SEQ ID NO: 80638 - DNA, 356 bp, Zea mays
  Clone ID: LIB3088-036-Q1-K1-A3
cttagcccctgatgatcatatcaatcggtctgaatggacttttaggcaaaaatgtactgttgagctcacccacaactggggcacggaaaatgaccctgaattcaaaggttaccataatgggaactcagaccctcgtggttttggtcatataggagtaactgtggatgatgtccacaaggcatgtgaacgctttgaacgtcttggggttgagtttgtgaagaaacctgatgatggaaaaatcaaaggcatcgctttcatcaaagatcctgacggttactggatcgaattatttgaccagaccattgtgttggtgctttttcagcatcttgatgaacagttgtggttccttatttggt

SEQ ID NO: 80639 - DNA, 185 bp, Zea mays
  Clone ID: LIB3088-036-Q1-K1-A4
gctcggttgctcctccgccagcttcatggactactatatgcccatcagggactcccgcaagcagggattcatgggggtggcgtgccgcaatagccagccgatgcggctctactccagcctgtggaacgcggacgactgggcgacgcagggcgggcgcgtcaagacggactggtcccacgccccct

SEQ ID NO: 80640 - DNA, 334 bp, Zea mays
  Clone ID: LIB3088-036-Q1-K1-A5
gactcgttggggggaagatctgtacaccctcatcaagttcactttctcaggcggaggtgtcatcccagacatgctcaagtccctgatcaacaagtcctccaaggagtgaagactaggggatgtgcatctttagtttaaactagacttctgtgcgctcctcggcgagtccttgtcatcctgtaggttttagttgagctgtcaggttggagctcctctgtgtaacgcttgcctggtactgcttcatcagttatttggttattgtgtttgtgttgagttgttaacttcaggggtgcaaacctggatgcttatttagttatgtgactactgctattcg

SEQ ID NO: 80641 - DNA, 326 bp, Zea mays
  Clone ID: LIB3088-036-Q1-K1-A6
gtactctttcgggctgctggatacaggttttcacaattcactattgtctgggtcggatctacaaactgaagcctcatatgaacagagtcagagggaaactgaaatttaaatctagtttaaaagcaagttttatgcgtaaaactggtggaaagaagagcccatggaaatagagactacaaaggcagggtgctggagtcactagtcagcacagttactatcctgagaaaaccatgaattcatcaaaaggagttagattaaaagcttagcattggtgtgttctttgttattgtcatggagcagattataggggtgcttcatggtttttt

SEQ ID NO: 80642 - DNA, 208 bp, Zea mays
  unsure at all n locations
  Clone ID: LIB3088-036-Q1-K1-A7
cttagcccctgatgatcatatngctgactcgtatcaagaatcaagatctggcaggcagctgtccttgccccttctcctgtctctgggtgggaggataggttagtcgttggattaggttggggagcgggaggtcggaggagtagttaggtaatctgtcctagtccatcaatcaacgacgtgtttcattatctctaatagggctatcgat

SEQ ID NO: 80643 - DNA, 348 bp, Zea mays
  Clone ID: LIB3088-036-Q1-K1-A8
atatgtcttgctaattgctcataactaccactggcaatggacttggtagttctctgctgcttccactgcggtgtatgtttacctctactccatatattattaccacatgaagaccaagatgtctggattcttccagaccagcttctatttcggctacactctaatgttctgcctaggcttaggaacactatgcggagccgtcgggtatctaggatcgacattgtttgtgaggaggatctacaggaacataaagtgtgactaagtgaagataatatcgccccattttgggtcatcgcatagaaaatgtatggcatagccttatttgattgagcgatcactgattctaaa

SEQ ID NO: 80644 - DNA, 319 bp, Zea mays
  Clone ID: LIB3088-036-Q1-K1-A9
cgcagccaaagttgaaagctgagttggatacaccaactctcttctaaggccctgcatatttccacagggaaggctgtgatatgtttcttgaaagatgacgactcagttcctgttgtcgatgattggggaggttgtgttggtattgttcaccgtgatgattgtaccttgattgtaccaagctggatgcacctcttcttgtgcctacttcaaccaccgtggagcacgttattgacctactccttagggagaaatccgagatggtggtggtgaagagcggtaacatgtacgaaggcagcttatgacccttgggtattttttt

SEQ ID NO: 80645 - DNA, 264 bp, Zea mays
  Clone ID: LIB3088-036-Q1-K1-B12
cgtccggaggccagctatgacatctgccgccgctctagatacattgagcgcccaacctacaccaagctcgacttgctagagtcccaggccatcttatccctaactgcttccctgaggatcaatggagctctgaacgtagacgaaaacaagttccagaccaacctggagccctacccaaggatccacttcatgcatgcgaccaacgctccaaacaaagctgactagaaggcccacaaccaacaacagtcacagagccaaaacaac

SEQ ID NO: 80646 - DNA, 154 bp, Zea mays
  Clone ID: LIB3088-036-Q1-K1-B2
gcaacgactggttcatcaaccagcggaagcggtaccggaagccgtcggaggagatgcagtagcccggttttgaatgggggcaggcgggccttttttaccgccgccgagtcctacttcgacccaagcttcgtggtagcaacgccggcaaagttca

SEQ ID NO: 80647 - DNA, 312 bp, Zea mays
  Clone ID: LIB3088-036-Q1-K1-B3
gggtcgacgcattcggactgctggataatatatgaaacaaacatctcgtcttaccccttaacttgtaatagcctgtgcagtgtaaaaataagtattaaaccagccgcttagaaccatgtttgctttgtgaccctagaaaccagctaggcacaagcagcacctcggccccctcctcggcgagacgtctactttctcgaggcgtacagtgaccgttcacctctcgggcgtgcctagctcgtcatcggtctccaatgccacgttcgtgctactactccaatcgttgctgacccgggtgatctccactgacttccg

SEQ ID NO: 80648 - DNA, 184 bp, Zea mays
  Clone ID: LIB3088-036-Q1-K1-B4
gaaagagaaggaaggagcggcacacctacgtcttataccatgtgaagaagactaccaaagctgagctccgctgctagagaaaggcccgattgttctaaccctgaaggaactgctaaacgacatcgaaattcaaaacccgaagtacaagaggcaccgccgtctactcgaaccgagtcaaacagac

SEQ ID NO: 80649 - DNA, 272 bp, Zea mays
  Clone ID: LIB3088-036-Q1-K1-B5
gctcatcttacttatttgtaatttggtaactctatttttccagaagatttttatttttctaagagagaattaactaatttttcttagtaaaatagaaatcccttagaaaaatgaggttgccaaaccagctcttaaaaatttgcctacggactctgttcctctgttatttcctgcttgctatcggtgtgatcggtataccttaaactgattgtaagttatgctttagagtgattgtttatgaacaaaactagctacatttctgactgctgcat

SEQ ID NO: 80650 - DNA, 186 bp, Zea mays
  unsure at all n locations
  Clone ID: LIB3088-036-Q1-K1-B7
ggcagatgaatcaggtcgaaaaggctaaatccgattgaagaccacatcagcaggcccaagaanaagtttagcagcaaaagccggcgcatttatcgagaagatgatagaggatcctcatgttaatgcacgactgcaacaggacttattggcagatgaaggcgagaccccgagtttatttgtggtgtc

SEQ ID NO: 80651 - DNA, 154 bp, Zea mays
  unsure at all n locations
  Clone ID: LIB3088-036-Q1-K1-B9
accaaaaaacangaaaagccgggcagggttcaaaagcacgagcggagaccaatacacagaaccaacgaagacccggcaacccaaaagcaaaatcacagcacgaacaacaacaggcactcacccgacaagaccacaacaagctaaacccgaacaa

SEQ ID NO: 80652 - DNA, 182 bp, Zea mays
  Clone ID: LIB3088-036-Q1-K1-C11
acagggccgacccactcgtccgcccgcgcgtccgcccatatcgatcgtcgaatccctccgtttgctacgcgtgcgtgtgagggtgatatcgagcgccggccggcctgcacttccgccgtgttgtgcgtacgtacgtacgtatacatgtatgtatgaatatgcccgcgtgtgatgcacgaata

SEQ ID NO: 80653 - DNA, 368 bp, Zea mays
  Clone ID: LIB3088-036-Q1-K1-C2
gcgtccgcgagaaggccaggcgcaagctccgcgcctacttcgccgagaagagctgcgcgcccctcatgctgcgtctcgcgtggcactccgcggggacgttcgacgtgtcgtcgaggaccggcggtcccttcggtactatgaagtgcccggcggaactggctcacggcgccaacgcggggctggacatcgcggtgcggctgctcgagcccatcaaggaggagttccccaccctctcctatgccgatttctaccagcttgccggagttgtggccgtcgaggtcaccggtgggcctgagatccccttccaccccggctgggaggacaagccttagccgccacctgagggccggcttcctgatgccaccaag

SEQ ID NO: 80654 - DNA, 189 bp, Zea mays
  Clone ID: LIB3088-036-Q1-K1-C3
cggacgcgtgggaaaaaaaaaaaaaaaaaataaatataaagaagggccgccccacaagaagaaggatgccaacggacgcctgcaggcgacctaaaagcccaccaagagggccaccaaacagcaaagcaccggccgacggccaacaacgtcacgacagaaaaaccgccggagctacccaaataaaccgcc

SEQ ID NO: 80655 - DNA, 162 bp, Zea mays
  Clone ID: LIB3088-036-Q1-K1-C4
gtccggtagattcgcgactggtttcctctagggcttagttctgttggcaaggcctcaatttagcgagatgtttagtcatgagttgcgcacacactataccaacctcccaagtacaaagcataccagtatattttgtgggtagtggcactcgtctagctgtta

SEQ ID NO: 80656 - DNA, 187 bp, Zea mays
  Clone ID: LIB3088-036-Q1-K1-C7
aaaacccggcccgacccacgcgtccgccggcgcgtgcgcccacaccagcctcaatccgagggcggacgcacaaaagcgcgcgggagaacctctgcggaggcgcgcgggccgctggtgacgaaccaagaagagccgaggaggcagagccgcggacggcaaagggcagcggctgggaaaacccggaagc

SEQ ID NO: 80657 - DNA, 361 bp, Zea mays
  Clone ID: LIB3088-036-Q1-K1-D2
cgacgcgttcgcaaagacggaaagctaccaccaaagccccgtgtgtcgagacgaggcgagatgcgatgaggtctatcttttatatatagcctgtagcgcccttcaaacacttcatcccgaagtcaccgagctgagctccaaagaatctagcagctaggagcaggccgtgtatacgccatccaccacggcaacatgtgctccggctcctggtcctggagcagcagcagcagcaagaagcgcccgtctcttgttgtcgtcaacctcaagcggcagcagctgcagaagacgccgccgccgacgccgcctcgtgcctcagttgctatcaggaggaagaggctgaggctgaggaggtggcaagccg

SEQ ID NO: 80658 - DNA, 114 bp, Zea mays
  Clone ID: LIB3088-036-Q1-K1-A1
cgtccgcccacgcgtccgcgtgtcagttttcgccgtcatgctagcgacagctctggtcgttatcagcacgaaaaggccttacagcttgtcgtcgagggaaaggggaggaggagc

SEQ ID NO: 80659 - DNA, 164 bp, Zea mays
  Clone ID: LIB3088-036-Q1-K1-D4
gttcgctgagaagcccgaggtccgcgatgctgccatgagttgctgctcttcgtgagatcaaggaagtcagctttaagaccaaggatgagaagaagtcgataaaggctgaggtgaccaagtcccagaaggcacagacgaagggagcggtccagaagggttccaag

SEQ ID NO: 80660 - DNA, 266 bp, Zea mays
  Clone ID: LIB3088-036-Q1-K1-D5
ggctcgacccactcgtccgctgactatttgatggtttggctgccagatcgcattggactgtctgacttagcatgtgctgaaatgtccaatatatagcatggattacttagattttgaatgtgctcaacatgctgaatcatcatagatatgcactgctgagtgagtttgcatgtgttacctaattcctaacgcttccacattggccttcgtatgcttgcagctctgatctggagctagctatatcacttcaacagcaagagtttgag

SEQ ID NO: 80661 - DNA, 61 bp, Zea mays
  Clone ID: LIB3088-036-Q1-K1-D6
gccacgcgttcgcccacgcgtccgcttaatcgttcggatctagatcagcgagcgggcgctg

SEQ ID NO: 80662 - DNA, 438 bp, Zea mays
  Clone ID: LIB3088-038-Q1-K1-E5
cggacgcgtgggctgtggacggcgaaaaccctagatctattacagcatcaatgagaacaggatggcagaaacattcgacgtggtttcggtgcacgaccatgagctcaaaatggcgaccttcgccttctacgcaaacaaaactatcaccaaagctccgcactcaagcttgcatggccacagtaccatcctagcctacgaactggtgttatcctaattgagcttttcttttcgtcaaaacatccttggcccctcttccctagaggttggctcttacctccgtttttctggtttctcgtgccggaattaacgttcttgaccttgtaaggccctccttctatgtctacatcctcttcgcacctgatgtttctttctttcttgctacatgcgggatcagtctcatcattgccatgtttgccagccttccgcgtctacctactt

SEQ ID NO: 80663 - DNA, 188 bp, Zea mays
  unsure at all n locations
  Clone ID: LIB3088-038-Q1-K1-E6
taacattccaccccccccccccacnaccataaactcaaaatgtctaccttcaccttctactcaaacaaaactatcaccaaatctccccactcaatcattcatatccacattaccatcctatcctactaactgattttatcctaactcatcctctcttttcatcaaaacattcataacccctcttccct

SEQ ID NO: 80664 - DNA, 444 bp, Zea mays
  unsure at all n locations
  Clone ID: LIB3088-038-Q1-K1-E7
acccactctactactctaagtttctaccattcttctngcttcaacantataatgtagcttgccaattttttcttggcctaacccctcttcnncttcccttcttcttctttcttctgcttcctttctttctctgtctctctctgaccttactcacgacaacttcttttataacatgaaagtaactgttcttatccttttcatccactactttactcttactctttatcctttttccaacatcccttctttttttctcttctcctacacattttcattctttcattctcaccttattttcctttatcttttttttctttattttatttttatcctttatttttatattttattattctactacttttttttttttattctaatttttcttttctttttttttactatttaatttctttatattttttattaaattatttttctatt

SEQ ID NO: 80665 - DNA, 367 bp, Zea mays
  unsure at all n locations
  Clone ID: LIB3088-038-Q1-K1-F10
acgcgttcggcttgtatcggtccaatctccctgcttagcaaactacgccgatngctggggcntagtcagtttatgatcccactgccacnnancttaaaacagcgggggcggaagtgattcccggcggcgtgcgagtgaaagggtgggtcatccagtcccacaaaggccctatcctcaacgccgcctctctgcaacgctttgaagatgaacttcaaacaacacatttacctgaaatggtttttggagagagtttcttgtcacttcaacatacacaaactggcatcaaatttcattttaatgcgcttgatgcactcaaggcatggaataaaaaagcactgccacctgttgaggttcctgctgcaacaaa

SEQ ID NO: 80666 - DNA, 203 bp, Zea mays
  Clone ID: LIB3088-038-Q1-K1-F11
ttcccgccagcctgcgagtgaaagagtgggtcattcaatcccacaaaagccctatcctcaaccccgactctctgcaacgctttgaaaatgaacttcaaacaacacatttacctgaaaaagtttttggagaaaagttcttatcacttcaacatacacaaactggcatcaaatttcattttaaaacacttgatgcactcaaagca

SEQ ID NO: 80667 - DNA, 414 bp, Zea mays
  Clone ID: LIB3088-038-Q1-K1-F12
cggaatcgaccgacgcgtgcgcccacgcgttcggccacgcgtacggtggccttcaacttcaaagatgaccctcccaaggaggctgctaggttcactttccatgtcatcatcatgaaccaccctgagcagattggcaacggctatgccccagtgctggactgacacacctcgcacattgctgtcaagtttgcggagctcattaccaagattgataggcggtctggcaaagagcttgagaaggagcccaaattcctcaagaatggtgatgctggtatggtgaagatggttcccactaagcccatggtagaggagaccttttctgaatatcctcctcttggtcgctttgctgtccgtgacatgaggcaaacggtggctgtcagagtcatcaaaagtgtggagaagaaggatccaact

SEQ ID NO: 80668 - DNA, 320 bp, Zea mays
  Clone ID: LIB3088-038-Q1-K1-F2
ggagatcatgtggctgctgaaaatcaaaagaaacaatccaagaaagcaagtgcccatgtggacgaataagttgtcatgccgtcgtttaaagaccgtctggcaacttctaatatcaacgactcctctccggatcattctgccatggaaactgaattcacagaattaacagaacagcagtatgaatacaaatcgacagacggagcaagcaaaagaggcggacgaaagaaagcgtcatcatccttggcaacgatactatctgatgttgatgaggaagttctacatgtccaaactcacaataaaggtactggaaggtagcccgc

SEQ ID NO: 80669 - DNA, 186 bp, Zea mays
  unsure at all n locations
  Clone ID: LIB3088-038-Q1-K1-F4
aaaanngggccgacgacgcgtccgtaaatcttatcaccactccatatcaaattatctcactccaccaaaacaattgggcatgtagacgaatatgttgtcataccagccattaaaaaccctctcacaacttctaatatcaaccactactcttcgaatcattcaacagcacaaactgcattcacagaa

SEQ ID NO: 80670 - DNA, 448 bp, Zea mays
  Clone ID: LIB3088-038-Q1-K1-F5
cgggcggggccattggattctaccaaggggataacttgaagctgatggatgatttggctgttctgagaccaacaatattggcaagtgttccccggttatataacaaaatttatgctgcaattacgaatgctgtgaagcagtctggggggttgagagaaaggctgtatcatactgcatacaatgccaagcgacatgccatgataaatggtagaaacccatcacctatgtgggacaagttggtatttaacaaaattaaagctagacttggtggacgaatgaggcttatgacttcaggtgcttctccattgtcaccagatgtcatggaatttttaagaatatgcttcggtgaagttcttgaagggtatggaatgacagagacatcttgtgtcatcagtacgatgaatattggtgacagatcaattggacatgttggatctccaaatccttc

SEQ ID NO: 80671 - DNA, 246 bp, Zea mays
  Clone ID: LIB3088-038-Q1-K1-F6
ataaaaaattctttatcatacatgcatacaatgccaatccacattccattataaatcatacaaacccatcacctatgtattacaaacttttatttaacaaaatcaaatctatactttatatcaaaatattcttattacttcaatttcttttccattttcaccaaatttccatataattttaaataatattcttctttcaatttcttcaaactattaaattacataaacaatttatttcatcaatac

SEQ ID NO: 80672 - DNA, 449 bp, Zea mays
  Clone ID: LIB3088-038-Q1-K1-F7
accacgcgggcgatacacctgtgctcacgtctcccttcccatatccatctactcactcgggccgcccctccggtcgtagccgttcgaaggtgcggcacccggcaaaccacccatttcattctacatgaatcccgagtacgactaccttttcaaacttctgcttattggtgattctggtgtcgggaaatcatgcttgcttctcagatttgcatacgattcttatttggacagctatatcagcacaattggggttgatttcaaaattcgcacaatggagcaagatgggaagaccataaaacttcaaatttgggatactgctgggcaagagcgcttcatgacaatcactatcagctactaccgcggagctcatggaatcattgtaagttggccacctgaactagcaacttctgaaattttgcaaccatattgaacatattacattaattgct

SEQ ID NO: 80673 - DNA, 397 bp, Zea mays
  Clone ID: LIB3088-038-Q1-K1-F8
cccacgcgtccgcccacgcgtccggtggcctccaactccaaggatgaccctgccaaggaggctgctagcttcacgtcccaggtcatcatcatgaaccaccctgggcagattggcaacggctatgccccagtgctggactgccacacctcgcacattgctgtcaagtttgcggagctcattaccaagattgataggcggtctggcaaagagcttgagaaggagcccaaattcctcaagaatggtgatgctggtatggtgaagatggttcccactaagcccatggtagtggagaccttttctgaatatcctcctcttggtcgctttgctgtccgtgacatgaggcaaacggtggctgtcggagtcatcaaaagtgtggagaaagaggatccaactggag

SEQ ID NO: 80674 - DNA, 340 bp, Zea mays
  Clone ID: LIB3088-038-Q1-K1-F9
cccacgcgtccgttcacgcacacgctatctttcaacttcaaacatgaccctctcacggaggacgctgtgcacaccttccatgtcacacataataaaccaccacgagcagattgctaaccgctctacaccacctctgttctaacactcctgacacattgccgtcaagagcacgtagctgatcaacaatatcgataggcagtctctcatagaccttgtcatgcatcacatattcctgctcaacgacgaagctcatgtggtgaatatcttttccactaatcccacatgagacaataactttcctgaatatgctacagaaagtcgcttttctctacgatacatg

SEQ ID NO: 80675 - DNA, 365 bp, Zea mays
  Clone ID: LIB3088-038-Q1-K1-G1
cggacgcgtgggtgagtccttgctggcgaaggtcgatatcctcatccttggtggtggtatgatctacacattttacaaggcacaaggatattctgttggaaaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaagcattggacaccaccaagactgttatttggaacggccccatgggagtgtttg

SEQ ID NO: 80676 - DNA, 393 bp, Zea mays
  Clone ID: LIB3088-038-Q1-K1-G12
cccacgcgtccgccgaagctgtgcctcgtaccatttcgatccaatggcgccgacgtcgaagctgtcgacgggcatcaagcgcgcttcgcggtcgcacgcgtaccatcgccgtgggctgtgggccatcaaggccaagaacggcggcgccttccccaaggccgacaaggccgccgccgccgtggaacccaagttctaccctgccgacgacgtcaagccccgcgttcccagcacccgcaagcctaagcctaccaagctcaggtcgagcatcacgcctgggacggtgctgatcctcctcgcagggcgcttcatggggaaaagagtggtgtttctcaagcagctcaagtccggcctgctccttatctctgggcctttcaagatcaatggagtaccgat

SEQ ID NO: 80677 - DNA, 421 bp, Zea mays
  unsure at all n locations
  Clone ID: LIB3088-038-Q1-K1-G2
ggcggacccacgcgtccgcggacgcctgnntgagtcctttctggcgattttcgatatcctcatccttggtggtggtaggatcttctcattttacaaggcacaangatattctgttggaaaatctctcgtggaagaggataaacttgagctcgcaacttctcttattgagaaggcgaaggcaaagggggtttctcttttgcttcccactgatattgtagtagcggacaagtttgcagctgatgctgagagcaagattgtccctgccactgctatccctgatgactggatgggtcttgatgttggccctgatgccaccaaaacattcaacgaaacattggacaccaccaatactgttatttggaacggccccatgggagtgtttgaattcgagaaatttgcagctggcactgatgcgattgcc

SEQ ID NO: 80678 - DNA, 439 bp, Zea mays
  unsure at all n locations
  Clone ID: LIB3088-038-Q1-K1-G4
ctccactggtgcggcgcggagcgaggacaacgtcaccttctccagcccccgcgcctgtggaggagtaggtgtagccgcgtaagcggcgtaagcctcagctcggctcagcagccgcctcgctcgaaccagaggagccaagcagaggaagcgaggcggcgggggcggagatgtcggcgggactggtgaccgacgaggccaccgtggggcggctgtaccggatccggcgcacggtgatgcagatgctccgtgaccgtggctacctggtggtggaccacgagctcgccaccagccgccgcgacttcctccgcaagttcggcgagtccttccaccgcgaggacctcctcatcaacaagtacaagaagaacgacccatccgaccagatatatgtcttcttccccaacgatgacaaagtanggatgaagcacatcaagaagtacgt

SEQ ID NO: 80679 - DNA, 428 bp, Zea mays
  Clone ID: LIB3088-038-Q1-K1-E4
cccacgcgtccgcatgggtgtcccatgtcttgctgaaagctgctcaattctatgccgatgcttgctataggtattcattagatcttcatcagaaagaagaaattgctgaggaaattgcacgtttgaagattggtatgagtgccttggcagatgctaagaaggctgcgaagggagttgctgcccagcttatggattccgtcaacaagctggaaagtaacatgaaaaccaacttggaaagggctatgaaggagaatgatcgtgtttacctgatgcgggttcccgctgctggttccttgggagccctctctgcagcgtcccttgtaaagcctacctctttgtctgaagttttagatgccagtaaggaaaggctttttttcatcacttgtgcctgatggcagcatgaaagcactttctaaatacacagagat

SEQ ID NO: 80680 - DNA, 458 bp, Zea mays
  unsure at all n locations
  Clone ID: LIB3088-038-Q1-K1-A5
aaaanccggcccgaccgacgcgtccgcccgaggccattttcctccacatttgctcttacgagaccatccacggcgtgggggtcaaagactactctgagccccgcaacaggtctggcatcctcgtcgccgacatgtcctccaacttctgctccaagcccgtcgacgtctcccgcttcggcgtcatctacgccggcgcacagaagaacgtcgggccctccggcgtcaccatcgccatcgtgcgcaaggacctcatcggcgccgctcagcccatcacgcccgtcatgctcgacttcaagacgcacgccgacaacgccttcctctacaacaccccgccctgcttcgccatctacgtttgcggtctcgtcttctaggacctgctcgcgcagggcgggctcgccgaggtcgagaaagaaaacgcgcgcaaggcctgggccctctacgacaccatctacgccagc

SEQ ID NO: 80681 - DNA, 339 bp, Zea mays
  unsure at all n locations
  Clone ID: LIB3088-038-Q1-K1-A9
cccgaggccaggttcctccacatctgctccaacgagaccatccacggcgtggagttcaaggactacccggagccccgcaacaggtcgggcatcctcgtcgccgacatgtcctccaacttctgctccaagcccgtcgacgtctcccgcttcggcgtcatctacgccggcgcacagaagaacgtcgggccctccggcgtcaccatcgccatcgtgcgcaaggacctcatcggcgccgctcagcccatcacgcccgtcatgctcgacttcaagacgcacgccgacaacgcctncctctacaacaccccgccctgcttcgccatctacgtttgcggtctcgtc

SEQ ID NO: 80682 - DNA, 327 bp, Zea mays
  Clone ID: LIB3088-038-Q1-K1-B11
gcgctcgtagggtttggtgtgttcacctcacctctcgcggcgacggcgaagccttctcttctgttcgctgggctccgctccgctcggtgtttcaaccatgatgtcgcggtcgtacaccaacctgctcgacctcgcggagggcaacttcgcggcgctgggcccggccgccggcgccggcggcggcgggcggcagaagcaggggtcgttcgggctgaggcggatgtcgcgggtgatgacagtgccggggacgctctctgagctcgacggcgaagacgagtcggagccggcggccaccagcagcgtcgtcttcgacgcgccctcgttcgt

SEQ ID NO: 80683 - DNA, 446 bp, Zea mays
  unsure at all n locations
  Clone ID: LIB3088-038-Q1-K1-B12
ctcgaacctcgatatccctcatnccatgcctgtcgtctggctgtctgccggtcagccgccgcttcgatgtgcctccgcgctgaatatncccttggccccataagggcctgatccttgaaaggcctcgccactttgatcccggcggcggtcggaggggagtggcgatgtccgaagtcggacgacacacatcctactcgagcgaggacgcactgccggagggccccgagtccgaccttttcgtatactactgcaagcactgcgcctcacatgtcctcatcaccgatacccaattgcagaaaatgcccaagcgaaagactgacagagcacatgttttagacaaggctaagcatctttcaaggctaaatgttaaggaggcaggaaaagtaatgttgaaacgtggtgaaggaaagcttgaaaagcagtttcgcatgagctgtgtgggatgt

SEQ ID NO: 80684 - DNA, 366 bp, Zea mays
  Clone ID: LIB3088-038-Q1-K1-B4
ggaagttgtctaaggaggtcgaagatagtgagcttgcagatgttgctgctgttagtgcgggcaacaactacgaaattggtaatatgatagcagaggccatgagcaaggtcggtcggaagggtgtggttaccctcgaagaagggaggagttctgaaaactttctctatgttgtggaggggatgcaatttgatcgtggttatatctctccgtactttgtaacagacagtgagaaaatgtctgccgagtatgagaactgcaagctacttttggttgacaaaaagatcaccaacgcaagggatcttatcaatgttttggaagaagccatcagaagtggatacccaatcctgataattgctgaagatattg

SEQ ID NO: 80685 - DNA, 371 bp, Zea mays
  Clone ID: LIB3088-038-Q1-K1-B8
aattcatcaagctcaacacgatctcaattcgattccagttcatccatccaacgcctcccggctgtacgtatagaagaaagaaggaagaaccgtcaccgtacgtcctcgccagtacaaataatggccctgctcaaagccgcgcgcgtcgccgatgtgcccaccctggacgtggtggtggcccccggcctggtggcggttgccaaggcgaggagcgccgcggcggtgggcggccggttctcggtgatcgggcaccgcggcaaggggatgaacgcgctggcgtcggaggacccgcgtctgcgggaggtccgcgagaacacggtccgctccttcaacgacgccggacgattccccgtcgactacgtcgagttcga

SEQ ID NO: 80686 - DNA, 411 bp, Zea mays
  Clone ID: LIB3088-038-Q1-K1-C1
tgctttcaaagcatttggaacaagtgatcaaatcaaggattccggggatccaatctcttataacaaagacaattgcagagctggaaactgaacttaatcggcttggaaaacccattgctaatgatgctggggggaagctgtacacgatcatggaaatatgccgtatgtttgatggtatttacaaagagcatctggatggagtgcgccctggcggagagaaagtttaccatgtcttcgacaatcaatttcctgtagctattaaacgattgcagtttgataaacaactctctatggaaaatgtgaggaagcttataacagaggctgatggataccagcctcacttgatagctccagaacaaggatatagacgccttatagaatcttgtcttattagtatcagaggtcctgctg

SEQ ID NO: 80687 - DNA, 281 bp, Zea mays
  Clone ID: LIB3088-038-Q1-K1-C3
gcgcccagcaggccattcttctcgccttactccctcacagaacccagtaaaatattgctagtcccgccgtcgagatggccccacgccgcctgctcgtcctcgccgtcgtcgccctcgcggccaccgtcgccgcggccaactccggcttcgcggactccaacccgatccgccccgtcaccgaccgcgcggccttcgcgctcgagtccacggtcttcgccgcgctcgggcgcacccgcgacgcgctccgcttcgcacgctttgctgtgaggtacggcaagagc

SEQ ID NO: 80688 - DNA, 434 bp, Zea mays
  Clone ID: LIB3088-038-Q1-K1-C5
cggacgcgtgggaagagcagctcttcgcttctcagggagggaacattatcctagctcagagagagaacgaatatggagattattatgaacaagcgtatggagctggcggcaaaccatacgccatgtgggcagctagtatggctcttgctcaaaacactggcgtcccttggattatgtgccaagagtctgatgcccctgatcccgtgataaactcttgcaacggtttctactgcgatggattccagccaaattcgccaaccaagccaaaaatttggactgagaattggccaggatggttccagacttttggtgaaagtaatccccacagaccacctgaagatgttgcattcgctgttgcacgttttttcgagaaagggtgcagtgttcaaaattactatgtgtatcatggtggcacaaattttggtcgcactact

SEQ ID NO: 80689 - DNA, 296 bp, Zea mays
  unsure at all n locations
  Clone ID: LIB3088-038-Q1-K1-D10
agcttaagaatgagatccaagggaagatatccatttcagaaaataaggagtcaaagataaaagattattcttgggtcataaatgggttaaacaagctattcagatcaaggcgtgttctatcctattcgtatccgtttgcattctacatgtttggtgatgagattttcaaggatgagatgactcctcangagagagaactgaagcagaatttgtttgaggatcagcaacaacaattagaatttaatgttgaaagattgtctggtttccttgagaaaaattttcaactttttaccgat

SEQ ID NO: 80690 - DNA, 414 bp, Zea mays
  Clone ID: LIB3088-038-Q1-K1-D11
actagcaggaggccgacaaggttagcagcaatcgcatgaaccctagcgccgccgcacccggaggaatgggtatcgacctcgtcgccggtgggaggaataagaagaccaagcgcactgcgcccaagtctgacgatgtctacctcaagctcctcgtcaagctctaccgtttcttggtcaggaggaccaagagcaatctcaacgctgtcattctcaacaggcttttcatgagtaaaaccaaccgaccaccaatctccatgcgccgccttgtcaagtttatggaaggaaaggagaagaacattgctgtcattgttggcacagtcacagatgacaaaatgatccacgacgttccagcaatgaaagttactgccctgaagttcactgacacagcaagggccaggattgtcaatgctggtg

SEQ ID NO: 80691 - DNA, 365 bp, Zea mays
  unsure at all n locations
  Clone ID: LIB3088-038-Q1-K1-D3
gattgatcaaaaggcttttttaatttagaggagcacggacanatttaggaggctgctgattttatacattaacttccccttcaaacatttggctctatggcaaagacggagaaaattgctttcattcttgagcaggtccggctatgcctggatcggcaagattttgtcagagcacaaattttatccaggaaaatcagtactagagtatttcacgcagatccatcaaagggaaaaaagaaaccaaatgatggtgacagtatttgtcatgatgctcctgcaaatattccttcccttctagaattgaagcgcgtctactacgaactgattattcgttattactctcacaacaatgattacttgtaaat

SEQ ID NO: 80692 - DNA, 174 bp, Zea mays
  Clone ID: LIB3088-038-Q1-K1-D4
aaaatcagtactagagtatttcacgcagatccatcaaagggaaaaaagataccaaaggaaagtgacagtattgttcaagatgctcctgcaaatattccttcccttctagaattgaagcgcgtttactacgaactgatgattcgttattactctcacaacaatgattacttggaa

SEQ ID NO: 80693 - DNA, 366 bp, Zea mays
  unsure at all n locations
  Clone ID: LIB3088-038-Q1-K1-E1
cccactcgtcctcccactcgtcttgtgatgtcctccgccgctgcattgtccatgggcaccggtggagactgagatggggggttttgtcaagacccacaagatcaatgcgtacttgaagcgtttccaggtgaagttcaagagaaggcgcgctggcaagacagactacagggccaggataagtcttattaaccaagacaaaaacaattacaatacacccaaatacatatttgttgtgcgatttaccaacaaggacatcacagcacaaatcatctctgctagtatagcangtgatatggttcttgcttctgcttactcccatgagttgccacaatatggtcttgaagttggtctgaccaactatgcatt

SEQ ID NO: 80694 - DNA, 434 bp, Zea mays
  Clone ID: LIB3088-038-Q1-K1-E12
cccacgcgtccggcttggagcggtccaagcgccctgcgaagcaaactacgccgatggcttcggcggcggcgtgggagggtccgacggccgcggagctgaagacagcgggggcggaggtgattcccggcggcgtgcgagtgaaggggtgggtcatccagtcccacaaaggccctatcctcaacgccgcctctctgcaacgctttgaagatgaacttcaaacaacacatttacctgagatggtttttggagagagtttcttgtcacttcaacatacacaaactggcatcaaatttcattttaatgcgcttgatgcactcaaggcatggaagaaagaggcactgccacctgttgaggttcctgctgcagcaaaatggaagttcagaagtaagccttctgaccaggttatacttgactacgactatacatttacgaca

SEQ ID NO: 80695 - DNA, 391 bp, Zea mays
  Clone ID: LIB3088-038-Q1-K1-E2
gtaggcaagtagccctccctgttccatcgtacccagcagagcatccagccgaacaacgaggcatgccgtcgaagccgaacgccgcgtctcgcctcgtcttcctcgctttcctcctcgtcattagcgccgccgcggccaacgatgacgccgcggcgcggcggacgatggagcagttcgccggcttccccgcctccgacgacggcgagggcccttccagcgacttccacgtcgactccgagggcctccagcgtcagattgatgaactggcctcgttctccgactcgcccgcgccgtccgtgacccgcgttctgtacaccgacaaggatgtgcaggctcgaaggtatataaaagggataatgaatcaaaactggcctgttgttcgagaagatgc

SEQ ID NO: 80696 - DNA, 330 bp, Zea mays
  Clone ID: LIB3088-038-Q1-K1-A4
cgccattcctactgctgccggaagctaaacgtgcttttgatcactgattggagtggtggcgaagaaaagggaagaaacttgtgatgacatgttagcacggttgtgctcgaaccaactgtcttgaccttgaatggacattttttatgtttattttatgtatgatcaggtcaacggcaagagaaaccaattacactgtatgagctttagatcacacctcaagttattctgtagatcttggtgctatttcatctgatgggtcatgtttcatgatgttgactccgtttcctgtgattgatttatagcgagcctgtacgttgtatgtcatgcaaa

SEQ ID NO: 80697 - DNA, 436 bp, Zea mays
  Clone ID: LIB3088-037-Q1-K1-F5
gtctccctagcaatctctagcagcagatcctcgtgcaaagcaaagcgctagccttcctactgtcccgatggcccgcacgaagcagacggcgaggaagtccactggcggcaaggcgcctaggaagcagctggccacgaaggcggctcgcaagtctgccccggctaccggcggagtgaagaagccccaccgtttccgccccggcaccgtcgcgctccgggagatccgcaagtaccagaagagcacggagctgctgatccgcaagctgccgttccagcgcctggtgcgtgagatcgcccaggatttcaagaccgaccttcgcttccagagctccgccgtcgccgcgctgcaggaggcgtccgaggcctaccttgtcgggctcttcgaggacaccaacctctgcgccattcacgccaagcgcgtcaccatcatgcccaag

SEQ ID NO: 80698 - DNA, 307 bp, Zea mays
  Clone ID: LIB3088-037-Q1-K1-F6
ccttggccccggccacattccggaggctggccaacgccaaccggcccttgcccggccgaaggctggtgttctgatcacccccccggccattgccgggacttgcttgcagcaaagcggagggaaaataataattattgtgttttaacttaaatgatttgcgtttcgtctcttgtactgcgtcgagcgtcgtcttcaattagcgagtgatgtaaaattgtgactgctaatctggactgttaattactggtgattgcagcagccatgtgtaacgtcgatgacgatataatcatggagcagttttacgcgc

SEQ ID NO: 80699 - DNA, 324 bp, Zea mays
  Clone ID: LIB3088-037-Q1-K1-F7
cccacgcgtccgcaagcttctgagtttacaagaagcctggactctaataattgatgagggattggcggcttcatttgtggccccggctactgattcgttagaagatgatagccaactaaccattgaagagtatcagaggagttgggagcagaacgaggaacttggcctgaatgacatggatacgtcctctgcagacgcggcttacaacacgaccagcacataatttttttagttttgttgtgccgaatgtatttgttacgctatcagtttactttgatgaactttcagtgtgtatactaatatcaacaacttatatttcctctg

SEQ ID NO: 80700 - DNA, 197 bp, Zea mays
  Clone ID: LIB3088-037-Q1-K1-F8
ttaccatttaaaattatcacaaaccttctgaacactaccaataacttttcctatattacatgtatacatactctgcataccctttttacaacaccaccatcacataatatttttactcctattctacctaatatacttactaccaccttactttacttttattaactttttacttatatactaacatcaacaactta

SEQ ID NO: 80701 - DNA, 190 bp, Zea mays
  Clone ID: LIB3088-037-Q1-K1-G12
cggacgcgtggggacagaatcgcagttgcaatctgttagatgtcttctaccggcactatgtatttttttttgtttgatgtgtaatgatgttactgttcaacgcttattaccctactatactgttggatgttctttggacctgtttcatttcgcacaaggattggacttccaatatcaagctacattttac

SEQ ID NO: 80702 - DNA, 378 bp, Zea mays
  Clone ID: LIB3088-037-Q1-K1-G2
ggcagtgattggtaccaaccttgcagtttttgaacctcaagtagtggtggtatacatggtgattcctgcttgtcagaagtgtaacagaaactgtgtcaggctttaacgatgtttaaagagtgtaaatttcagttcattgggggtagagcgtatgctgcacataggccattttccagtgcagtgttactaattaatttggtcattgtttttctctctcccaaaaaaaaaaaaaaataaaaaaaaatccatctgcaatggtgaagtgttgttactgttgtctactattactatccatgagatctgtttggaatatgcatcggacttgtggtgaacatgaatgactttggtcattctgagataatattagctacttacaca

SEQ ID NO: 80703 - DNA, 262 bp, Zea mays
  Clone ID: LIB3088-037-Q1-K1-G3
gccgcctgatggccctccagctcagcagcagccacagcagccaattcagaactgaagtcctgtcaagatgttgggtattggtactgctctaactgctcggcaggagaatgcaacccccgtgggtcaccagctttcgtaatttcttaatttgtggttaacagtaaaaactttgttgtattgcttatcaacgtttgaagaaaaaccgtgagatataccggatgtatccagcttctggattttgtggtacctgctgagtttcatc

SEQ ID NO: 80704 - DNA, 251 bp, Zea mays
  Clone ID: LIB3088-037-Q1-K1-G4
gaccggacccttcccacggggaagcttttgttctgatcacgcgcgcgtacattgtccagacttgcttgcaccacatcggagggaaaataataataatcgtgtttcaacttaaatgattttcgtttcgtctcttgtactgcttacagcgtcgtcttcaattagcgagtgatgtaaaaatgcgactgctaatcttgaccgctaatttactggtatctcagcatccatgtgaaaccttgatgacgatataatca

SEQ ID NO: 80705 - DNA, 380 bp, Zea mays
  Clone ID: LIB3088-037-Q1-K1-G5
gttcgttttgtacttaaaccatgtggatcgaggcgtattggggtgtattaacgtggattgtgactatttgtggatctattacccctcaatccacatggatttggaaaaaaaatgactcatcataatatttctcaatcatatccaattgactcggggcataaataaccgcactagagtctacagtgaggtgacacctgtccgactattgagtgactgaaacaaattagagattgtttgagctcggacaataccatcgagtgtacaggtttgttcaagacccactggctataagctactctatcctttcacaaagactgttttgcagaggtacatgatagaatttattgttatatgctataagagacaatgtcttggctttc

SEQ ID NO: 80706 - DNA, 152 bp, Zea mays
  unsure at all n locations
  Clone ID: LIB3088-037-Q1-K1-G6
aaaaaaaaaaaaaaaaannaaaaaaaaaaaaaaaaaaagggccgcccttttaaaaaaaagggggcttcctaacgcgggagggcgaggtcattaccttttgggtcggcccccctaaattaactaaattgcccccccctttaacaacaacggaa

SEQ ID NO: 80707 - DNA, 364 bp, Zea mays
  Clone ID: LIB3088-037-Q1-K1-G7
ggaaaaacagagaaatagcaaggattaagagggacagggaggaaagagatgcgaggttgagggagaaggaggagatcgagaaagtcaggaatatgaccgaggaggagcgtcgcgaatgggagcggaagaatccgaagccgcttcgtcagacgaaacagaagtggaagtttatgcagaagtattaccacaaaggcgccttcttccaggaaggtgctgatgatgttatccagtcagcgggtaaagaggatatctacacccgtgatttctctgagcccactggagaagataagatggataagagcatcctgcccaaggtcatgcaagttaaacatttcgggcgcaacggcaggacgaaatggacgca

SEQ ID NO: 80708 - DNA, 327 bp, Zea mays
  Clone ID: LIB3088-037-Q1-K1-G8
gagctgagctgctttgattgctcaaactgagggagctgacgaatggagttggtcagggatggcagttatacctagcttgaacgattgtcaggaccgatggcgatgacagattccaagctggttagatcaccttgtcgggtctaggcggaatgtatatttgctgctcatgatattatagtatgtaagaccataaacggtgagttggtgatgcgctatatatcttggaataaagctcaacttcttcctggcatacaccaatgatttttatgagcccacttggaaaatataagatggataagaacatcctgcccaaagtaatatcaattg

SEQ ID NO: 80709 - DNA, 372 bp, Zea mays
  Clone ID: LIB3088-037-Q1-K1-H1
atcatacattcctttgctagattgtatcatataagcttcatcgaattcaagggagaaatgaacataactgttgctttgcagcacagtttagcaagaaaaattaaccacgcaatgtgcctctgggttgcttgcagggaatgcgaacatcaatggtatttcggatacctaattctagttgtgcacttgtgctgtcaatgtcacaccatacatgtggtagagagagacctacatcctgaaaccacatagcttacggtgattattgagacttcagagagcatctcgagcagcaatcctgcatacaattgcgtccgggttttcatatgctttcatttctccgcgaataatgagaacttttggtaataccagctcatc

SEQ ID NO: 80710 - DNA, 382 bp, Zea mays
  Clone ID: LIB3088-037-Q1-K1-H10
ctcgcgcgtccgtacagagcggcagcccccttgtccccaacatgatcaagcagtgcgcgggctaccctctggaccggtgcgtgcgcaaggaggtcttcaccgattacctgaccggtatgaggaccaagtccctctgcgaggagctcatcaaggtgctcgaggccatcaaccatcgcaagcacatatacccgatgctcgagtgcctcaaggagtggaacggcgcgcccctgccgctctgctgagctcatctgagctgcacgcacctgctccgcacaaagaaagaaatacaatagtatagcggctcatgacagcgtttcaagatcgtttatttacaaccagactagcagaagatgctctttatatctaccagtcgcttgtatta

SEQ ID NO: 80711 - DNA, 267 bp, Zea mays
  Clone ID: LIB3088-037-Q1-K1-H2
cccacgcgttcgcccacgcgtccgcccacgcgtccgcccacgcgtccggttctagattccgccgcccgcgaagaccttatttttgaagctcgtatgtccatatggtttgcagaacatggacgatgagacggcttgaccttatattcccgcgtcctattacttcatagcttattcgggatgttctcagacatgttattcccatattgacgatgcttaagatttgtactgtattgtttcagtgacagttacgcaaaacgattatgatct

SEQ ID NO: 80712 - DNA, 400 bp, Zea mays
  Clone ID: LIB3088-037-Q1-K1-H3
cagaaccagccctacctccagtcagtaacaccaccacagctgcatctccttcgcatgccggcctcagaatgcgaaccgatgtctcgatcctcatcgcaatgctgatgctatgtgcttccctcatctgaaggtagtcctgcacaacatcatatgcggcgtggtgcattagagctgaggatttcacattgagctgctaatagcaattctttccaccacctttatgtagcgatttttttcttgttctgtccggtgttttgaaggatggatggatgttcagcttgatacctcaacggtgacacttgtgtgtgctgccgctgcctctaggtatattttggtacatatgtgtggtgatacattgttcaggtcatcttttctactgccaaaccctggcccggagggc

SEQ ID NO: 80713 - DNA, 297 bp, Zea mays
  unsure at all n locations
  Clone ID: LIB3088-037-Q1-K1-H4
gccacgtgaacgtgacgagaggagaggggagaaggagcggaaacgagacangcatggtgaggggggggatatgaggcggggcgaggcgctataggaggcacgacttggaggacagatcaaagcggcaccgcaaagacaagcagaagaggaggcacgattccgattctgattgataacggccctgcgcctgctcctctatgactactgtatactgcgaaatttcaaacccatggagccgcttttgtttgatgtatgcctacgctttaaattatgtttgccctaatgatgtttaaggat

SEQ ID NO: 80714 - DNA, 383 bp, Zea mays
  Clone ID: LIB3088-038-Q1-K1-A1
ggaaaaatctttgtctgacatactgaaaaatttagaacatgaagtatctaacataaaaatattcacatactggcatggggattggtcaaaaagagcttcctcattagcatctctgttggatgatgactttgtggatccatctaaagagctgaacctgcaaaatatgggcaaatcgagatctggtgctctgacaacttccatagaccaagtcgcagttatcgaattgctggttccttcagtatttagagctgtagtgtcattgcatcctgctggatctactgatcctgatgcagtggcattcttttctcccactgagggaagaagctatcttcatgcaaggggcacgtcggtacatcacgtgtttaaacattgtaaggaacatg

SEQ ID NO: 80715 - DNA, 286 bp, Zea mays
  Clone ID: LIB3088-038-Q1-K1-A2
gggctcatttcctattctaaatactccaatgtccttcattctttttacgacaaacttgatcgggatttcgtggatattaggacaaaaactcgcatcttttttcaaagagaagactatctaaacaaaattagacatcttcgtggtaaatatgcgctgacagaaatctacaagattaccctctagacaacacaacttttgagagatgataattttgcacaaaatgcattcacccgatatgataagatctgcccattctacatatatttttgcatgatgcgcaacatta

SEQ ID NO: 80716 - DNA, 150 bp, Zea mays
  Clone ID: LIB3088-038-Q1-K1-A3
tccgatgccaagttcctccacatcttgtgtttttagaccatccaccgcgtgaagttcaatgagtaattttataccgccaacacgtccggcattctcgtcgccgacatgtcctttcaactttttgttccaaccccttgacattttccgctt

SEQ ID NO: 80717 - DNA, 236 bp, Zea mays
  unsure at all n locations
  Clone ID: LIB3088-034-Q1-K1-G6
ccatggcctctcctactctgggcgcgacggcatcngacgtaggggtatcctctgaggctggatgctancntggtgtgtgtggacagtggactgcatcttcccttggcttgtacacatatagtagtgaacatgattcatttacatctattttcttccacgaacagatcttataccataacacactgaaacacgtcggagtccggtcctctttctaaaaaaaaaaaaaaaaattaaaa

SEQ ID NO: 80718 - DNA, 431 bp, Zea mays
  unsure at all n locations
  Clone ID: LIB3088-034-Q1-K1-G7
gaagctcgcgtcctattccgcctattctttctcgctataacatgaatcccacctgtacgtcttcttagatccagagctcggttcncctcttccttcctctttatctttccaatcactccttctcctaattcaccaattccttcaccaagttcacttcttcttattctcatattactattctcaattgtttttttagacccttctcaatttattctttttatgtacttatatattatatatcttcttcttttttactcctttattttttattatcatttttttattttccttctttattttttattcatttttttcctatcactcttttcttttacttatttattatcttttttacattttttctttctcttttcttatttttttttttaatctttttttcctctcttttttactttatttcattttatttt

SEQ ID NO: 80719 - DNA, 346 bp, Zea mays
  unsure at all n locations
  Clone ID: LIB3088-034-Q1-K1-G8
agaattctcttgtggattttccgacctgggcttgattagcaaatggctacagtttgttcgatgtttgtcatgtattttgacagtgcctaactttgtgttggtttatgaagctgtcctggcggacaatggcaggctgaaatatattgaacgcattgcggagagatttgttgatttgactatggaacataaggnggagatgaaggttgtggtcaggacagttatttcactcaccaaggaggaggagaaagaactcaaggaaaccttgcangatatccttggggaaaacaaaactattttggttgaacagaagattgactacaacatcatgggaggattagtgattgaa

SEQ ID NO: 80720 - DNA, 244 bp, Zea mays
  Clone ID: LIB3088-034-Q1-K1-H1
ctttccttggtcctcactgagaacccccttcggttgcgaatatctattcactccggtcgtgccctctggagtgtgggcgcggtacagccgattttgttacatatctaggccattcagttgtaaaactgccatcttaagtgtaaatacgtgtttaccaaaggttgtttttgtccatttcaccttatgagcttctctataacacacagttaacacttaacagctactccacatttgcagtctcctt

SEQ ID NO: 80721 - DNA, 355 bp, Zea mays
  unsure at all n locations
  Clone ID: LIB3088-034-Q1-K1-H10
gcgtccgagaaattcatttagcagaggcccaaaaacaagcataccgtcttgtgaaaagacacagagaacttggacaatctttggcggacttcngaaaggcgattaagcttttgggctcttgtgaaggagatttgatggaaaaggtgttttctgaagttggttcaaagtcagagatgttgtcaataaagctacaaagagaggcagacaaccttctctttaactttgaagaacccttgaaagattatgtgcgtgctctacaatctataaaagccactatgctggatcgagctaatgctttcaagcagcactttgatttggatcaagagaagaagtattaaaagcttaatcttgaaaa

SEQ ID NO: 80722 - DNA, 441 bp, Zea mays
  Clone ID: LIB3088-034-Q1-K1-H2
aaaaaaaaaaaaaaaaaaaaaaaaaaaatttttaaaaaaaaaaaaaaaaaaaaaaaaagagtggattattaaaaaagaaggaaggaaacgcccccccctctttaatttccaaaattccataccccctttctccccacattatatcttttttattttcccccctatttaattttctctccccctttttacacaacctttactcttaaaaccccttattttcccaaatttatatccttttataacatatccctttttccccatttcgttttatccaaaaaacccccacacttttccctcttcaaaaattttccacaccctatttccaattttacaccccccctatcacttctttttaatcccggttattttttttttctcccactatttccccttttacttttcatttccctattaccccccccttttcatatttctcccttc

SEQ ID NO: 80723 - DNA, 319 bp, Zea mays
  unsure at all n locations
  Clone ID: LIB3088-034-Q1-K1-H5
gtccagctggcactactgttccagcctccagtccacatcctcgtccaggtgcatactgcagggagggccacgctnnacacnntataaattacgtactttcgccaatcttactccacatacttgtatactcatgtattacacccatgcttattgttgctctcaaccactactagcactactatttgtctagttccataattacaagtacctctcccctcatattaacttgatcattgtccgtgtataatggactatttgccgaaaataaaatatattacaatccattctttctaacaaacaaattgaaacatctttaatt

SEQ ID NO: 80724 - DNA, 396 bp, Zea mays
  Clone ID: LIB3088-034-Q1-K1-H6
ctaggctcgtcctccagctcctgttcgtgatggtggtggtggctccattcttggaggaagtgggtccaccattgcttgaggtgtgccatttggtacgagtagtgccatggcacacagggctgttgatgctgtaatgggtctccggactgttcggcatgagattgttatctcagaagctgctgctgctgcccctcctgctccagtgatgaacgctaatgcttgcagcatccattctaaggctttccaagattgtcttaacaactatggcagtgagatcagcaagtgccagttctaccttgacatgttgaacgagtgccgccgtggtgttgtctgcctgagcttttgctccaattgggattattcatggattctcttttcactcccatgtatctcatt

SEQ ID NO: 80725 - DNA, 352 bp, Zea mays
  unsure at all n locations
  Clone ID: LIB3088-034-Q1-K1-H7
acgcccactcgttctctgactcctgggtcctcacccatctcaagaaagagatggctgcctcggagaagctaaagttagtgcggcgtcgggaatgnacattcttctaacgaagtgttcacttggcccgtcatgggatccaacagtaattgaaagttttatgggctaaaaaacagcgtctacatctggtgcccctacctgtctttgtgattttttatgacttttatgttcttgtatcgtgaaccgcagtgaacaacggttgttgcaagttccagggatatctntggaagtggtaaacaaatgcgtcttatttctatgtaatattagaccccgtgcgtgtgtggtttcgaggtac

SEQ ID NO: 80726 - DNA, 200 bp, Zea mays
  unsure at all n locations
  Clone ID: LIB3088-034-Q1-K1-H8
ttaaaaaaaaaaaatcctaacgtggttttcctttaaaagctggtggttggccttcacctntttacatttttagtctagggctccttttaaattgtttgcatagtggctcgatttttttaccccaaaacaattctcatgttcgtctgcatcttcttcttccaccttatctatcaaccttatgttcatcttcatctatatat

SEQ ID NO: 80727 - DNA, 355 bp, Zea mays
  Clone ID: LIB3088-034-Q1-K1-H9
gcgtacgagctggttgagaagtgcttgctggtcttgctgtaccgtgacaggtcatctatcaacaaatgccatattgccaagatcagcaagggaaggatcaaccatctacccaccatattccttgaagacctactggggcttctctcactttgaaaacccagcccagggcgctgtgggatcatggtagattaatgcgccgcgcacgccgcatatcatgccatgaacttagttgaggccaatctgtgctgctgaaatcaaacacttatgaacgtttgttctgaacatcactggaactctccatttgcttgtatgacatgcttatggttcagcgagtttaattccaacgtttggtcac

SEQ ID NO: 80728 - DNA, 56 bp, Zea mays
  Clone ID: LIB3088-035-Q1-K1-A1
cccacgcgtccggcaaggcgctcgacatcttttccgacatgtgggacttatgccat

SEQ ID NO: 80729 - DNA, 377 bp, Zea mays
  Clone ID: LIB3088-035-Q1-K1-A10
ggattcaataccatttaccaaactctttcatcaattctcatctttcttctcacgaactattaattcatcatgtcgagcacagctggccaagtcatcaaatgcaaagctgcggtttcatgggaggcagggaagccacttgtgattgaagaagtagaggttgcgccaccacaagctggtgaagtgcgtttgaagatcctctacacctctctttgccacactgatgtttacttctgggaagctaagggccaaactccattgtttcctcgtatatttggtcatgaagctggaaggattgtggagagcgtaagtgagggtgtgactcatctgaaaccaggggaccatgccctccctgtgtttaaccgggagtgtggggactg

SEQ ID NO: 80730 - DNA, 152 bp, Zea mays
  Clone ID: LIB3088-035-Q1-K1-A3
gcgagccatacaccaatttagggctgccccaaccctcacctactacattcacgaaaccttgcaccttctcaaaagtccagcgagcgaaagcagctccctcaaatgcacggcaacgactaatgcatcattgccaatcaccagaggaagagcat

SEQ ID NO: 80731 - DNA, 282 bp, Zea mays
  Clone ID: LIB3088-035-Q1-K1-A5
cctcgtagcagcagcaccagcagagtctccttcctctccggcggcgatgtctgggcgcggggagtgctgctaggggctgggcaagggtggcgccaagcggcaccgcaaggtgctccgcgacaacatccaagggatcacgaagccggcgatccggaggcttgcgaggaggggcggcgtgaagcgcatctccgggctcatctacgaggagacccgcggcgtgctcaagatcttcctcgagaacgtcatccgcgacgccgtcacctacactgagcacgctcgtcg

SEQ ID NO: 80732 - DNA, 332 bp, Zea mays
  Clone ID: LIB3088-035-Q1-K1-A7
gcacgattctcttctcgtcccgtagctctcggttcggcgatgtcggggcgcgtcagaggctgcataggagctgggcaagggcggcgccaagcgccaccgcaaggtgctgcgcgacaacatccagggcatcacgaagccggcgatccgtaggctggccaggaagggcggcgtcaagcgcatttctgggctcatctacgaggagacccgcggcgtgctcaagatcttcctcgagaacgtcatccgcgacgccgtcacctacaccgagcacgctcgccgcaagaccgtcaccgtcatggatgtcgtctacgcgctcaagcgccagggccgcacgc

SEQ ID NO: 80733 - DNA, 379 bp, Zea mays
  Clone ID: LIB3088-034-Q1-K1-G3
catacctgatgctggtgggatcgcctctgttccctctggcactgagagccacatgagtagctctttttgcagatggatggcggtggaagcgactagtccaaagagtcttgaggatttacgagctagccttgtaggttgcaaaatatgcacgtatactgccgatgaccaatgataggatcgatcctgcgcccttagttgataagtggccatgatctttgcatggatgatcagtatctgtcacggttttatctttgttgccagtctgtataacacacatatagattgttgtgacatttatttgcttgctgtttccacaatgtactgtcttagacttgtagccatatgctagtttattgcttcaagagcttgatttcaatta

SEQ ID NO: 80734 - DNA, 171 bp, Zea mays
  Clone ID: LIB3088-035-Q1-K1-A8
acaagccatacacaaatctaatacaacacccttccatcaacatacaacaatcacacaaaccgggcgcctttacaaaaagacgagggcacgaaaacagctcccacaaaaccacgtcaactacaaatacatcatttccaatcaccagaggaaaagcatcctcaaattaccatc

SEQ ID NO: 80735 - DNA, 215 bp, Zea mays
  Clone ID: LIB3088-035-Q1-K1-B1
cggactcttgtgctgactcgtgggaaaaatttaaaaaaaaaaaaaaaacaaccaatctaagaaaattttaaaaaacatacgcgtccattcaacatcatacctcctctataacgtcacctaactacaattcacttcccatcatataacaacttacttacttcaaaaaccctttctttacaaaacttaatctcctaacaccacatccattacttatc

SEQ ID NO: 80736 - DNA, 358 bp, Zea mays
  Clone ID: LIB3088-035-Q1-K1-B10
gcggaaaagagtagtggcctgtaggatgcgaagaacaagagctcaaatcggatggaatcttataaagaaagaaagatcatattcatggcgatggcaagcctggctcgacggaagggttacgccgtcgtcttgtcgtcgaggtcgacgttttgtctgacaagctggaggggattcgcgtccggatctgacgaaaacgacgtcgtcgtcatcggcggcggtcccggcggctacgtggccgccatcaaagccaggcagctcggtctgaaaaccacttgcatcgaaaagcgtggcacttctcgcggtacctggctaaacggtcgatgcatccttttcaaggcacttctgcattcttccacat

SEQ ID NO: 80737 - DNA, 366 bp, Zea mays
  Clone ID: LIB3088-035-Q1-K1-B11
gggagcgtgggagggtccgaagtggtagatagcgagtctggttcctgaggtgtgcttctttctacggcagcaacgtcacaatcagaaacaacaatggccaacactaactcggaagatgatccctctctggatctcatgactgagctccttcgacgactcaagcgctctctcaaacctgacaagcgtcttattctcattggcccacctggatctggaaaaggcacccagacaccaagcataatagatgagtactgattatgccactgagctactggtgatatgtgaagagcagctgtagcagctaagacccctcttggtgtcaaggctaaagaacctatggataagggagaactcggtgctgatgac

SEQ ID NO: 80738 - DNA, 429 bp, Zea mays
  unsure at all n locations
  Clone ID: LIB3088-034-Q1-K1-E4
acggcctggggaactgtaattgtcacagcaggccgtggaggtcagatcagagcatttcagaagtttgggtttcctgctcgagtatagtactgtagctatgagaccgctgcctggtcttggcgtctgccctgcagcaagacgggtgatttttgtgtatagataggtgaaagtttgggtgatctgcacgcagtctgggactggattctgttgctgctcctaggtgcacctgcctgcgaacttcaactaacctacgacctggtactcaaggtacggcgaattcgtttgcccggaattgtatatgagaatggagcccgggaaggacgagcgggcgtcngccggtttgagctagatctttgggatccttttggcagccatcttttcaatctgtttctccattgagtccaagttaactttttcaattttttttac

SEQ ID NO: 80739 - DNA, 359 bp, Zea mays
  unsure at all n locations
  Clone ID: LIB3088-034-Q1-K1-E5
taaaccaaattcaaagtcacagcggcgtaactctcgtcgatgtctggccgcnncaagggcgggattggtctggggaagggcggcgccaatctccacctcaaggtgctgcttgacaacatccagggcatcaccaagccggcgatccgcaggttggcgaggaggggcgtcgtcaagcgcatctccgggctcatctacgaggagacccgcggcgtgctcaagatcttcctcgagaacgtcatccgcgactccgtcacctacaccgagcacgcccgtcgcaagactgtgaccgccatggacgttgtctacgctctcaagcgccatggccgcaccctctacggtttctgcggttatgtcgcccc

SEQ ID NO: 80740 - DNA, 363 bp, Zea mays
  Clone ID: LIB3088-034-Q1-K1-E7
atttagtggtctggatcaatggaagggttttgtcctagccagccggcaaagatgagctggtgattgtaatgaggaggagaggaggccactgctaccctactacgtaccctcctctttgtgtgctgccatccgtccccgttagacgatcgaggagagaataacgcatagctctctgctcccggcctgtcttctgccgtcccggccgtttaatttactagtgtgttcgtcctatatgtttagcagcagcaggtgtattgtgcgggtatgtaatggtattgcaactatattgggtgtaaaaccataataaatgtgggcaaatatgcaaggaaaaaaaaaaaatataaatatataataattaaatta

SEQ ID NO: 80741 - DNA, 332 bp, Zea mays
  unsure at all n locations
  Clone ID: LIB3088-034-Q1-K1-E8
aaaaaccaatctaacaaacaaggtcgtagtctaactccttacagaanccaaaaggcggccatttttttatagtggagttggtctcatagtttctcgttttcttatattactcaccataagcttacaattctttggctgcacaaggtttggaccattttgttcataaattgcgatttagggcagccgtatgcagtcatccatttgtatattcttccattgctgtgataagatggtaagaatgctcaaaatttttttttggttaaatgaaaataagaaaaactcattttgattctaaaaaaaaaaaaaaaataataaaaataaaaaaataatat

SEQ ID NO: 80742 - DNA, 409 bp, Zea mays
  unsure at all n locations
  Clone ID: LIB3088-034-Q1-K1-E9
tcatactcccactcttccgctctattacactcctctcttctgctgaacttccctaatttaacctgcagacttttctaagagggaggaggattacnaaccacatcaacaanttcttctagcaattgaactctactaatctaaccttcaaaatgaactcttatagatcaccattactatccacaacaacaacattacaatattcatcgggagatcaattcattaccgctcaacaattatcatcactatcacgcatcaaactccattaccattgttagaccgtcttctattcaaattgactttttcaacactattaacccaaaattcacaccacacctaaattaatcatcggttttctacattaattctacatatcataatgatatttgttatcttgcatctatattttata

SEQ ID NO: 80743 - DNA, 217 bp, Zea mays
  Clone ID: LIB3088-034-Q1-K1-F11
gttgttctttcggctaggttgatctctctccttccctcttttgcgtcaggaaggagcaggttgcatacctgatctgagcactgtaattatttcttcagttctaccaaaaaaaaaaaaaaagtataaaaataactataaaaaaaaaaaaaaaaaaaaaaaaaaaaaaaaaaaaagtaaaaaaaaaaaaaaaaaaaaaaaaaaaggggggccgttttaa

SEQ ID NO: 80744 - DNA, 72 bp, Zea mays
  Clone ID: LIB3088-034-Q1-K1-F12
aattcccgttcgacccactcatcctcccactctttccaattaaataaatttttcttcttacctcttatacat

SEQ ID NO: 80745 - DNA, 435 bp, Zea mays
  Clone ID: LIB3088-034-Q1-K1-F2
cactttgctatgcataatattgtttaagctcaaacgcctattatacgtgcgcattgcgagccacccgtgcagcgacggtgtggtctgaccagtacaaaactgcttcccatgtacagaattgcgtgaaggacagaaaattatgatgatcacatttagcagcattgtctattgcatgctggaccgctggaggcatatttcagtccttcatgcagccagaatatgtccgtgacagacccaaaatcttgacgagcttattgacattcatatgccaccgagacatgatcactggttactgtacaccaacagtatctaatcagtctactcaccctggcaacctgcgcgtcaattaattaattcatcgattgttctcttcaattaattaattcatccattgaatcattgttgttcaaccccttctatttcccattttttttt

SEQ ID NO: 80746 - DNA, 432 bp, Zea mays
  Clone ID: LIB3088-034-Q1-K1-F4
acggcgcatgcggagctgggccgcgcgcacgctctcctggaccactccgtgcggcatgtggaggccgcgctgctgcaggtgacgggctgcagctgccgctgcaagttccgggcgcgtgtgactggcggcggcgccatgagctccgaggtggccagctacgtctcctccgttgtcacggccgagggcggcgacgccgaggtggacgacgacgacccgtaccgccaccaccggcagctcaccgccgacgacgacgcgccgagccacgctaggatgatggacatcaactagcggccggccggcgcccggccatctcgtactcgtacgtcatgcatgcaacatttttttccctccttctccttcctccccagctcgcccatgcatgcactcctttctggctagcaagcatggacgagaggccgtgatggatggatc

SEQ ID NO: 80747 - DNA, 409 bp, Zea mays
  unsure at all n locations
  Clone ID: LIB3088-034-Q1-K1-F5
gtatataacatgtaccagctgaaactagatatggctgcactgntccagcgaagcagcatcaagagcagcgtgccacgatcagaagaacctcctcatccactcatctctaggctgctaccaataggaatatgtatgtgaatttaaagccatatatgaccaaggaagaatgggaggaagacgaacaaagctagctagactagactgcagcccctctaatccatggccattcgctgattaatacgataatatctcttatttgttggcttcttctagcttgcttcaatttcctagtacagcagtttatgtagtatttcctagattgttagcgcaaagctgcctttttcacccatggcatccactctagtggtgtccaggtagtgtcgatccaattttagtataaaggtcactt

SEQ ID NO: 80748 - DNA, 392 bp, Zea mays
  unsure at all n locations
  Clone ID: LIB3088-034-Q1-K1-F6
aaaaaggcattataatggccattgaggcttaaaattgccattgggagtgctagangtttggcgtggcttcatcacaggtgcggccgtggcattcttcataggaacattagttccaagtgcatattgcttgatgatgactatgagcctaagatttctgattttggcttggcaaggcttatgaatcccatcgacacccacctgagcacatttgtgaatggtgagtttggtgacttagggtatgtagctccggagtatacacgcactcttgtggccactccaaaaggggatgtgtatagctttggagttgtcttacttgaacttgttactcgtgaagagcccacacatgtgtcaaatgcgccaaaaaacttcaaagggagtttggtggattggat

SEQ ID NO: 80749 - DNA, 427 bp, Zea mays
  unsure at all n locations
  Clone ID: LIB3088-034-Q1-K1-F7
gcactcatcctcccactccttcaacctctcttactcatattctttccctatcccatatgattaacttgacggttatctctaagtgagcagacgacattccttatttttcacatattccatattatatatcaatattatcttaatcatagccttctacacatacacttctactacttttcatcaaccaaaaaattacaaaaatgagtgtctacaatataaatgaccctacaatcttttcgaaatatataaccaatatcaatttctttctactgattttaattatatatacncaacttttttttctaatcaaatgtcaaaaataatcttaactttgaaacctctacttacttcactttattatacttcctccatattattttaccaatttaaatttattatatcaaaccttccttatttccattttaca

SEQ ID NO: 80750 - DNA, 504 bp, Zea mays
  unsure at all n locations
  Clone ID: LIB3088-034-Q1-K1-F8
cccgggccgacccactcttcctcttactctttttctctttctgcccccctgtttttttttgtgagncgttgattttctttagttcaatttttaaacgttcaagccgcgactcttttnncttcaacttcccatccaccttttccaatttcttctttatatccttttcctccttttctctaaatccatttttttttattttctttcttcttccatatcccctctccttattcttcttcattttatatccttttatatatatataccttactttattctttttattattcttttctatattctattctttccctttttcttttacttattttatatttcattctctatatttattatttttattcctatttcttccttctttttatcttatatttctttcttcaattctttctactcattctttttttttttatataaattttctatattttacattttcttccttattttattctcttcatatccattaattattctatcttattt

SEQ ID NO: 80751 - DNA, 367 bp, Zea mays
  unsure at all n locations
  Clone ID: LIB3088-034-Q1-K1-F9
cccactcttcctcccactcgtccgctgtcttctttttcgggacaccttcacacctatcaacgtgttcttgtacgggagggcgtgttttaggatnncctactacaaccatgtcaagctgcatgcgctcaatgctaatgaggcacagaagaaagccacacatgcttattattatgccgggtcgctcttgcatgagcgcgatggacacatttatcgcaagatcgacaatcaagcctagagggccagatctgatcctggcgcccccatattgggcatctgatgcaaggtgcaaagactggtgtttggtctgcggttgctttcaaggagttttttgccggttgcttgcacatctttaactcttggtcttaag

SEQ ID NO: 80752 - DNA, 222 bp, Zea mays
  Clone ID: LIB3088-034-Q1-K1-G11
aaaaaaaaaaaaaaaaaaacaaaaatttattctaacaaaaaaaaaaaaaaaaaaaaagaaaggttctaaccaaaagggggtcggggccacacatcacacttcctcttacatacaacatattacaactcaatttacgtccttcttaaataaaatcaacttcccctacttttccatcgatcatactcataaaccccttaacatccccattttaatcaacttcct

SEQ ID NO: 80753 - DNA, 384 bp, Zea mays
  unsure at all n locations
  Clone ID: LIB3088-034-Q1-K1-G12
cccacgcgtccgcccacgcgtccggaacgacgaggagcttgggaagctgttgggcggcgtgaccatcgctcacggcggtgtgctccccaatatcaaccctgttctgctgcccaagaagacggcggagaaggcgtccagtggcgggagcaaggaggcaaagtcgcccaagaaggccgccaagtcccctaagaaggcatagactgactgtccggagtgatctgatgtttagcagtaccttgttaccagtatgcggtgatgcgtaggctgcagatgggacgaatgtgcttgtatgtgtatgtgtcctgctgcaagttgtcctttgctatttagaatggaagaagaaatgccttgtttcnnaanaaaaaaannnnnnnnnanannnaa

SEQ ID NO: 80754 - DNA, 414 bp, Zea mays
  Clone ID: LIB3088-034-Q1-K1-G2
ctagaagctcgcgtccttgtccgccttgtctttctcgctataacatgaatcccaccgggacgtccctctagatcgggacctgggtgcgcctcttcctcccctgtgagctttccaatcactccttctcctatggcaccatgtgcctcaccaagttcacttcttcttatgctcatagtactaggctgggtggtgttggtagacgttgctcaatttatctggtttgggtagtgatggatgatatgatcttcgtctatttgagctgttaagactgatttacatttttccacgtcacgttttgtttgatggtgcattgttccaaatcacgtttttaatactgcattactgtttcttacatttaacaagttttattccttgaatttttcaaactttaattcttttttttcatttttattt

SEQ ID NO: 80755 - DNA, 318 bp, Zea mays
  Clone ID: LIB3088-034-Q1-K1-E12
gattcaaccctgattcccactagccaaagttcttttccacccgtttaattccctcgagtggcatgcatatatgggggcgaccgcgtgtcactgcaaaaagtccccaactccgattgctatgctgtaaataattgccttccccgaagaccccccattccttccttgattaaaaaaaatcacgagacactgccattcaatggtacaaaagaccgagcttgtgaatgtcaaatttctgcgcaactatcgattcttctgcttacaatatgcttgttttaatcaagctttactttctttttcttcttaagtacttctccatgt

SEQ ID NO: 80756 - DNA, 316 bp, Zea mays
  unsure at all n locations
  Clone ID: LIB3088-034-Q1-K1-B8
tcccttttannatttcttttctnttctnttattttatattcattttttcttaatcaacctccttttaactctctttttattccctttttatacccattaactatccaatgtnttcttccacaatcaatttcctatttcataacttccaatcttaataatatattacctatctaccacntttttaatttcttctttttcacacctcaaactcaatagttctattctttgcctcatattttttaccatacataatacaccttttttttttttcctttcttttcccaatttttcttttttaatccttcattattttttt

SEQ ID NO: 80757 - DNA, 345 bp, Zea mays
  unsure at all n locations
  Clone ID: LIB3088-034-Q1-K1-C1
cactgttctagatcgctacgccccctttttttttttttttaatctaatgcgccggtttttttcaactgttctgggttaacattnccttcttnttntatttacactacttttctcaatgaacaaacacattcattactcttaagaacattcccaatttctttccccacnttttatctcacaaatatttttactactcatactctaattaaacttntttttaaaattccaaaaaaaataatcatacttcaacaagcccctaaaatttcatcacatttctttttctctctttctatttatcatataaacaaacactaactcttacaaaagcaatatctatctcacatt

SEQ ID NO: 80758 - DNA, 151 bp, Zea mays
  Clone ID: LIB3088-034-Q1-K1-C11
tctggggaaccaacctgtttaatggacctagcccgccttaccggctcgtgtaaatcctctgtccatcaattctgtaactctgttttatcgattaatgaaaagaaccgggcttgctcgccccataaaaaatttaaaaaaataaattattttt

SEQ ID NO: 80759 - DNA, 391 bp, Zea mays
  Clone ID: LIB3088-034-Q1-K1-C12
gtacatgaaggtcaagggtaatatgtttaataacaagagggtacttatggagagggtccggaggtccaaggctgagagggcgagatagaatacactttcagatcagtttgaggccaagcgtgcaaagagcaaggcaatccgtgagaggaagattgctaggagggaggaaaggctggcccagggcccaagagaaccaacagcacctgtcgcagccccagctccatctactggggtgccaaagaaagcaaagaagtgaagtatggaaacaaagctgtagctttttggtactatataagcatgactttggagcacctgaagtattttgctgttctatagtttcgtgtctcaatattctgagtcttgtatctctaccgttctgttggataatgca

SEQ ID NO: 80760 - DNA, 181 bp, Zea mays
  Clone ID: LIB3088-034-Q1-K1-C2
cagagacaccatcccgcccctccattgcttataccaattcttcaagagcgacacattttgatattgtctgtaagaagctcgagtgcacttacgagcataaccccaacaacgacgtcaacttgacgcatttgcacttatcactactaaaactatcacaactcactaacagacccaacagatt

SEQ ID NO: 80761 - DNA, 156 bp, Zea mays
  Clone ID: LIB3088-034-Q1-K1-C4
aaatccaataattttccccattacctacaaaaaaaaaaaaaaataaataatatacttattaaaacaccaaaaaaaaaaatttttttttattaataattaaaaaaaaaaaaattcttccccttttttataaaatccaaacattctttacccattaat

SEQ ID NO: 80762 - DNA, 264 bp, Zea mays
  unsure at all n locations
  Clone ID: LIB3088-034-Q1-K1-C5
cggattttnagcacctgtataaagttctagggctcgtgttcttacaacacacacacaaaaagagagagacgtgcggacattgatgactgatgacatttttgcggtggatcaattgttccggaagaagcgggcgaaaaatggtggtcgagggacaagcacgttcctgtcgtgccctgtggaaattcctagccgctgctgcaacccatcaccaatgtgctctcgttgtcccttttctctactatactactacttctgcattccttc

SEQ ID NO: 80763 - DNA, 358 bp, Zea mays
  Clone ID: LIB3088-034-Q1-K1-C6
gcgagttactgctgcagggatgtatttccttgtttttcctgtgtaccgttttgaacaaaataagctggctgcttctgcaagagagggggatggtgcattctttaaaagattggatagctttcagccatgtgacatacatgaactgaaacctggaacacacttctttgctgtctacggtgacaacttcttcaagagcgctagttatactatagaggttgtatgtggtgaatcttttcctgccgaaaaggagatgatacgaaatggggaggccttaaagcatgccatgtaatgtctgtaccaaagccagtatttgcaaggatagaaaccgaggtggaagaggaagcccaagcaagttcaa

SEQ ID NO: 80764 - DNA, 247 bp, Zea mays
  unsure at all n locations
  Clone ID: LIB3088-034-Q1-K1-C7
gaaaaaaaaaaaaaaaataaatttaaaaaatttattttttcttcctctctaaaaaatccaaggttactttctcattcaaggaaccaagcttcccttctcttncntcccccaaattcaatttactatccttccacctacatccaattcactggcaaaaccctacaacttctcaacttaataaaaccccaacacatcccactttatcacctttcataatatccaacattcccccacctatcatccttcc

SEQ ID NO: 80765 - DNA, 443 bp, Zea mays
  unsure at all n locations
  Clone ID: LIB3088-034-Q1-K1-C8
cgacgagcaggcgctcgtcaaggccctcgtccatctcagcccgtcagcgtcgccatctaggggtgggggaggcacttcgagtggtagagcggtgtcntgttctatggaccgtgcgggtcggagctggaccacggcgtggcggcggtgggctacggcagcagcaaggggcaggactacatcatcgtcaagaactcgtggggcacccactggggcgagaagggctacatccgcatgaagaggggcaccggcaagccggagggcctctgcggcatcaacaagatggcatcctacccgaccaaggaccattgatggatcatggacgacggagatcatatctatcttcccttccctttcatccgactctttcgatttccatcgtttgcccccttttcctgaatgtgtgtgttttttttatatattactgtgtcaagtaatttctcgat

SEQ ID NO: 80766 - DNA, 434 bp, Zea mays
  unsure at all n locations
  Clone ID: LIB3088-034-Q1-K1-D10
atacgcccactccgttcgcttcaaggtgcctgtagctttgtgcatcccggaccatcggcatctcccgccagaggccatgtggcatggtgagctggcttcatcnaacgaccatcttctagaagctggcccggcgaggcccgccaatgctcgcgcgctacaacaatgaagcccaccatcacctcctctcgagatccagacctccgtgcgcctcgtgctccccggcgagctcgccaagcacgccgtctctgatggcaccaaagccgtcaccaagttcacctcctcctaggcttgcacgctcgccctttgtaggcttctcttgtgttgatgttcgccttgtgttgtagttagatgttgctggtttctctgtcggcgctgctcttcttttgtaggaactgcgtcatgtaacccaacaaggacttgtttatttgtgaatc

SEQ ID NO: 80767 - DNA, 397 bp, Zea mays
  unsure at all n locations
  Clone ID: LIB3088-034-Q1-K1-D2
ggaatacccggcccgacccactcgacctcttactctntttcttactcgtggtctttctcttgggaaaaaaaaaaaaacaaaaaagaagttttttttaaaaaagaaagaagagcccacaaacacccctcaacatttccttcccccctaaatcacccccccttacttcccccttctttctaccttctacctcttcttttttttcccctaaatttaaaacacctcccttctttttacaccttctcaactcttaaaaaccctcccctttcccactcttaattcccttacacctcatccccctttccccattttcctttttttcctatatacccctcccttaattccctttcctacattttctctccctttttcctatctcctaccccccctttttcccccc

SEQ ID NO: 80768 - DNA, 409 bp, Zea mays
  Clone ID: LIB3088-034-Q1-K1-D4
acgcccacgcgttcgggccttgaaagatcagctaattgatgcaataaatcatgtgcacaaagtgtctgaagtacatgtttggtgagccatatgcctaggtttttgggaccggatgggacaggatgtgctgagtttcctggagaatcgcaaagaaaacaaagcctggtataaaggtgcacgagtcgcaatctcagtattggatgatacttttgcatcccagctgcaacagctgctaggtaatacaatcccaccgaaggacctagagccacccagatctatcgtggaagttcgctctattctctgcaaagatgcaccccgccagaagaattctagtttctattattgatgatcaagcttaactgtacatagtatccatgcgcttcgcatgcagcttttctcttggagagag

SEQ ID NO: 80769 - DNA, 296 bp, Zea mays
  unsure at all n locations
  Clone ID: LIB3088-034-Q1-K1-D5
tcaatcttaaaccacatcattacattcttaaagtttttgaangacaagctgcccaattcatcatctttattcacatctatggatatcccaccaccccgtgtccctctctgtatcttgggttatgttttcattggaatctaccacaccgtcttctactatttcaaacttaggtttatcttctcagtattctcctaattattttgtttggcatcaaccctttcaaattcaaactcttaatttttgtttttattctaccctccatttttgtatttattctactacatttttaattattc

SEQ ID NO: 80770 - DNA, 338 bp, Zea mays
  unsure at all n locations
  Clone ID: LIB3088-034-Q1-K1-D6
tccgaaaaaaaaaaaaaaaaaaaaataaacaatttttttatttctaaaaacaaaaattancnnnaggaatgtttttttaaaaagggagccccgcccccccccccccccntacntcccctttcatccaacctcaatattctcttctatttcccccccaaaataaaattcactccccttttttttccaacttccaaacctaaaaaccccttccctcccccaccttattcccctttcaacacattccctttcccccctcttctctttatccctaaaaccccccccccttttcccctttacatcattaccccactccttaaatacccatttttactcccccc

SEQ ID NO: 80771 - DNA, 352 bp, Zea mays
  unsure at all n locations
  Clone ID: LIB3088-034-Q1-K1-D7
ccccncccttctccttcccctctttcttccttttccttcactctctttctttccctctcccttctttttcctccctccttctcccccccttctcatcctcttttctttttttttcccctttctttttcctctacccttcctcttcttttcctccccccttttttttccttccttattattccctcctctctcttcccaccccctatctttccccctttttccttacttccctctctccccctctccctcttttttattctttctccttccttccctccctccttctcctcttttcattattttctcctncttctcttccccttccctccttcttatttcctctctttttctt

SEQ ID NO: 80772 - DNA, 270 bp, Zea mays
  unsure at all n locations
  Clone ID: LIB3088-034-Q1-K1-D9
ttaatttccggtcgaccgcacacaaactantctacaaaacaagtaaatcaacatatatttttacatacactacacaaaacatttatgttggtttttcttaaaaaagatcagaacaaaaaaaaatttccntaaaaaaaaaaaaaaaaataatatttaaaatataaaaaaaaaaaaaataaaaaaaaaataaaaaatttttttttttttttaatatcaaaaaaatatatattaccttatatttaatatatcatatcttttttttttcttctt

SEQ ID NO: 80773 - DNA, 425 bp, Zea mays
  unsure at all n locations
  Clone ID: LIB3088-034-Q1-K1-E1
tctgttcccgcaccccgtctcctctcctgtagtctgcccgtcnccgtctgctgcttcatgtgaagcgcggggtgaggcatcatgatgggtctgaaggccgttgctttgtacataaacccaaataagtttggtgctatggcgaagccctgcatgccataaatggtggccttcctcaactgtctggccttaaacaaacagaacgatgacaagtgtatcaagcagaaagatcttttggttgcatgctctcatgctcagaatgggaggccaaagaacgcatccaataccatcaattaccatctccagcgacttgtgcgaggcaagttcctctagtcgctgtgtgagatcatttcctcatccagctttatgccttgtaccgaagtaaaattgctgaaatggggcattaatgtgtttgcttagattggaca

SEQ ID NO: 80774 - DNA, 396 bp, Zea mays
  Clone ID: LIB3088-034-Q1-K1-E11
gctcgacactgtcactagctagttgctctactagagggcgggtatagagctgcctgcagggcgccgctgagaagggaggagcggaagcgacgatgaggtcgtttgctcctgtctttctgtcggcggtcgtggcctggctggagctggcgggcaccgctcatggcggcaacttctaccaggacacagagatgacctggggcgatggccgcggcaaggtagtggacggcgggcgcggtctggacctgacgctggaccgcacgtccggctccgggttccagtccaagagcgagtacctgttcggcaagatcgacatgcatatcaagctggtgccaggcaactccgtggcacggtcaccaccttctacctgtcgtcccatggcgacgcgcacgacgagat

SEQ ID NO: 80775 - DNA, 394 bp, Zea mays
  unsure at all n locations
  Clone ID: LIB3088-034-Q1-K1-B7
tactccatatnnnnntnncataaatgattcgtttattttctggggtgtaaaattctacgatggttttctaatgcaggcggggcagactttntaatntncaatcataactgcttctccncaaggactcacagactttcaccttctaaaagggatgggccttcccactccttgtgtacttcaatggtaataattgtgtcatgccatctcctgaaaattatccatggctgccgaatgcaaaccctctaacaaaacaaccattgacactcccactctttatattcttggttgcctttgctgctctgttggcttatgcattattaatgtgatcaaaatgtttagcaagcttcaagtttatgtccgattccataaagtgcactgcaacaggatatttatt

SEQ ID NO: 80776 - DNA, 300 bp, Zea mays
  Clone ID: LIB3088-022-Q1-K1-B2
gtgggtcggaacgattcgtaatcggattgcttctctaatttatataaactttgattaggtggaacgattccgggtgcaatgcgacacaaacgaacaagtccgacacaaacgaacaaggcctaagccttctgtttaacagtggtcagtgggggaggctgcctcggcgtcctttggagtggcatgtagactctggaagggctggcgctgtggggaatgacgtgttctgtggaaagccttagctctgctttggctggaatgctaccttgtgtataatggaaaagtaacatgctggattaagct

SEQ ID NO: 80777 - DNA, 441 bp, Zea mays
  Clone ID: LIB3088-022-Q1-K1-B3
gagaaagaatataaagtgcaactaaatctggggaactgttgcctgtaattttatgtacatcagcggatatacttgtcgatattatgtacgaagtatgctgcaaattgcaaccggtggctattgggactttgagaagaaagctattacaaactacatgagggcggtttgcgaatacaaaattccaacaattttcctagcttaagagtcagtttggataccaagggctaatcagtttcgtgcttcataattttgttagaaacacgactcaagtttcgtcacataccctgtaaagctagtggcgctcctgcttctttacacagaccaatcattcctctgattcttcccaactagaagtctggatgtgcaacgctgtgcaagtttacaaatgcagtgtcaaatgcggcgcatgggaactgaatctgcagcgaatgtgcaagaaat

SEQ ID NO: 80778 - DNA, 389 bp, Zea mays
  Clone ID: LIB3088-022-Q1-K1-B4
cgagatgtacataaagtgcaactaaatctgtagaactagaagactgaaattatatgtacgtgaacaggttatactggtacgatgttatggccgaaagtttgctggaaattgcaactcggatgctattgcgtacttgagaagaaagctattacaaactacatgagggcggtttgcgaatacataatttcaacaattttactagcttaacagccaatttggataccaagagctaatcagattcctacttcataattacgttagaaacacgactcaagtttcgccacatacactgtaaagttaacggctctcctaacttctttacacagaccaatcattcctctgattcttcccaactagaactctggatgtgcaacgcttcgcaagtttac

SEQ ID NO: 80779 - DNA, 346 bp, Zea mays
  Clone ID: LIB3088-022-Q1-K1-B6
gacagacagacagcaacggatgctagtttcaccaaaggtcacaggaatacctgctcacgtgtcacaaaggctgtaagattggttttccccttctcttttacgacgtgcaatgcatcctactcagggctaaccaccagttgtcatgtgtactccgatagttttctaccatacattgctactgtatctctatctatgcagctgctgttgcattcattaacatataaaaaataaatacatacaaagataaaataaagataactaaaacccacacaaaattctatcgggtaaagccaatgattagaagcatcattggcgcaacgccctcgacctattctcaggctttaaa

SEQ ID NO: 80780 - DNA, 438 bp, Zea mays
  Clone ID: LIB3088-022-Q1-K1-B7
cacagcagctctctaatctcccccacctcttgcaattcaatgtttcacataaccagctggctggggatctccgtcccgggagcttctttgacaccatccccctatcttgtgtgtcggataatcctggcctttgtggcgcgaagctcaattcatcttgtcctggtgtgctaccaaaaccaatcgtgctgaacccaaacacttcttccgatccaatatcaccaaccgagcttgtgcctgatggtggtcgccatcataagaaaaccatactcagcatctcggcccttgttgcaattggtgctgctgttctaattgctgttggtgtcattaccatcactgttcttaaccttcgagtgcgtgcccctggatctcattctggtgctgtcctggaactctcagatggatatctcagccagtcgccaacaaccgacatgaacgcag

SEQ ID NO: 80781 - DNA, 437 bp, Zea mays
  Clone ID: LIB3088-022-Q1-K1-B8
cagcagaggaccttcaactggaatgtggtctcgaactcttcgactaaagattacaggaggagatgggatccagaaaatcgatgccaggatacctgctgggttcttagaagggatgacaagaattattccaggcttggctggagctaatattatggaaaggcttcggaatgctcctgttgatacagacaacccccagaatggtcaaatactgcttgattttgaggacgccatgggagataggatccaggtgtttattgcatgagctgacggtgtctttgctagaatgctcgtgcacagcaaactctggaagcatggtcgtttcaagtagcatcagggtacatgcatcttgctattggcgcaaccctatctagtagttgaattagataatttggacatcgattatatcttggcgaactagtatttacaaataacagact

SEQ ID NO: 80782 - DNA, 118 bp, Zea mays
  Clone ID: LIB3088-022-Q1-K1-C10
gaacaaaggccagtagctagcttgcctgcttcataaatcgtgccggattgtgatgggcgtcttagatttggcgcccctggtttggaatatagttgtatccgtgccttccctgcttgct

SEQ ID NO: 80783 - DNA, 449 bp, Zea mays
  Clone ID: LIB3088-022-Q1-K1-C11
gtcgaatttaattatggtacgttaattgatcacgtgatgcaaaggacaaaatttaagtggaccccaagatgttgtaaagcgtgagctactccacaaggtgatgctaatggacggacctaaagatggacagacgaagcaagtactggaacaaaggctgagcgtcaagtgatcgccgtctaacaaacactaacctagtgtttcttccaggttatagttttgtgctgctgttgatggtgttaagtgccggtgggctcgaccttcttataagtctaagtaattcttctatacttcttattgaggatggtcacatgagctagcatatatttcaaacttacaaataatttataacatctcaaagttattcctttgaaccacttttgtaatcactccgataaatacaatgtaaacttgttgtaacttgtaaaatttgggtataagatttttccgct

SEQ ID NO: 80784 - DNA, 442 bp, Zea mays
  Clone ID: LIB3088-022-Q1-K1-C2
ctcacgcgtacggcaaactctgtgagcttctaggccatcagcggcgaacctactgaaacgacagagattgagctgcagttccatggctctcggcatgacaagttctccattgatctcatggctccccctcctgggaagctgtctgatgatatagatgcctactccatccctgatgcatataagaagggattggattctgagatggacatgttggggagaggaaattcggaaaagaaggatggtgaaaggactctgggagggctggatattgatttggaggaccagaaggtgcaaagaattccagccgatgagtccacgcccaagaagctcacactgcagttggatttggagaagcccagtcttggtgatgaaaaatcaccatcacagcgactgcagccgcatcaacatccacaacaattgcatcagctgaagccctcaaaag

SEQ ID NO: 80785 - DNA, 441 bp, Zea mays
  Clone ID: LIB3088-022-Q1-K1-C3
cacaaagttgtttgtgcatcgcggcggcgacaagggggcgacgaggcaggcggagcgggcggcggctacagcggcagcagatctcacggaatggcggcgaaggcaatctcgagccccgtgccggtggagtggtacccgacgctggccgtcgtcatggtatccgtaggcctcatgttcaccgcctccttcttcatttatgaagcaacttcatcccggaggagccgtagcctgtcaaaggagatcgcaacagcagttgttgcttctgttttcttgggctttgggtctctgttcgtgcttcttgcaagtggtgtttatgtctgatgactggctatgggccgtgtgtgcttgtgttctgcatcccgagttgtagacttggttatgacagatcctcaaagctgttgtcctaacgaatatagagcatttgaacttattctagaacga

SEQ ID NO: 80786 - DNA, 358 bp, Zea mays
  Clone ID: LIB3088-022-Q1-K1-C4
caaaaaaaaaaaaaaaaaatcaaaaaaagtttaaaatttacaacaaagaaaacaataaaaacgttctgttacaaccggaaacggagctcacacaaaaacaataaaaatctatcttataccaaatcacataaaaaaaagcaccctccccctacataccccaattttattccccctacctttctactcttactcctttttaatacacaaccaaatttcatttcattgccacccttttaaaaacccctaacctctaaaacccctgactttccccaacttattccccttcaataacacccccctttctccctctacctaaacaccaaaaacgcccactctattcgcctttcccacaatttcc

SEQ ID NO: 80787 - DNA, 416 bp, Zea mays
  Clone ID: LIB3088-022-Q1-K1-C5
aacccaagtgagactcatgtgaattacgttacacaacatgtggaaacatatgacgacactgatatttacaacggggctgggcttcacgatgaacaacacaatcatgtggctcgagctactacatctgatctcaaaataaatctgcttttagaatgcctgaccatctgcagacatacacaacaagatataccagaaggattttacgatctgctaccggaaatgccagcgcaaaacgatgcaaaggacgactgagtgtgttaaagcaactaagatcacctctctcataggctctatagctctagtgatgaaattcgtacatacgtcatttatgaaatatactgttatgggtaatactacacttcatcagatatgacttgacatcttcattgtatcgatggacagatatggactaatgc

SEQ ID NO: 80788 - DNA, 153 bp, Zea mays
  Clone ID: LIB3088-022-Q1-K1-C6
tcttcctacaacacttaatactcaccagaattaattttcacaacaaaaaaaaataataacacgtcatgtatatttataacggagctctgctccactcatatacaacacaatcatatatctcttaactacttctatccatatctcaaaataaat

SEQ ID NO: 80789 - DNA, 193 bp, Zea mays
  Clone ID: LIB3088-022-Q1-K1-C7
gtgtgctgtggcccggtcattatgcatatgtgttttacattgtcgtagtgtttgataagtgatggatggtgactgggttggttgtgtcaactgtcataactattgtgcatttttggacgctatatgtgtagccttgatatgaatagatttactgtacttataagggctggtgtgactcagccgtttgctcctt

SEQ ID NO: 80790 - DNA, 193 bp, Zea mays
  Clone ID: LIB3088-022-Q1-K1-C8
cccagcgtgcgccgaccattattcagatttttcgtacatcgccataatgttcgataaagtatatattacaacgtgggtaggccatatcaacattcataactattgtgcattttagtactctatatgtgtatcctttatatgaatagatacactgtacttataatagctcatgtaactcatccctttgctcctt

SEQ ID NO: 80791 - DNA, 440 bp, Zea mays
  Clone ID: LIB3088-022-Q1-K1-D3
cgccgcaccagcgccagcccgcgccgtggtcagatggaggtccttcaccgtgcgcgcctgtctcggcaaggccgccgggagcgcgccgccgtggcaatggctgccagcgccctgcttgccggcggtgccatggcccatgaggtgctgctgggcgcaggcgacagcgggctcgtcttcgagcccagccagttcaccgtcaaggccggcgacaccatcacattcaagaacaacgccggctatccgcacaacgtcgtcttcgacgaagactaagtgccgagcggcgtcgacgccaccaagatctcgcaggaagagtacctcaacgcgccaggcgagacctacttcgtcacccttaccgtgccgggaacctacggcttatactgcgaaccgtattaaggagcctgaatgtgtcggaagatcaccgtcaactaattaagctagct

SEQ ID NO: 80792 - DNA, 79 bp, Zea mays
  Clone ID: LIB3088-022-Q1-K1-D4
aaaaaaaaaaaaaaaaaaaaaaaaaaaaattaaaattaaaaaaacaaacaaaaaaaaaaatgccaaagttaaatacaca

SEQ ID NO: 80793 - DNA, 437 bp, Zea mays
  Clone ID: LIB3088-022-Q1-K1-D5
cgttatcctgccatcttcagcattcagtgtgaaggaaggcacctacgagaatactgaaggatgcacccagtggaccatccgagccgttcctacggttggtgatgctagggatgactggaagatcatccgtgctctttccgaggttgctggggctctactgccttacgacagtctctcagctgtgagggaccggatcagtacggtcgcacctaatttagtacatgtagacgagagggagccatccacaatctccgtcgaggtgaagccgcctgtaaagcaaaaggtcagctcgacgccattcaaaactgtggtggagaacttctacatgactgatgcaatcactcgagcttcgaagattatggcccaatgcagtgcgacattgctgaagaagtgagatttgcacccttcgagctaatcttcagcaaacaacttcttag

SEQ ID NO: 80794 - DNA, 356 bp, Zea mays
  Clone ID: LIB3088-022-Q1-K1-B11
ctcacgcgtacggtcgacccggacggctccattgatcgcacctggtcgtggggatgaggatggccaggacggagctcaagatggagcacgagctcgacaaatggcagaccgaatctgacaggatcagggacaagtatcctgacagagttgctgagactggcgagacagctggccaaactgatgttcacaagattgaccagaagaatgaccatgtcactgctgatctgactgtctgtcaggtggggtatatagtgaggctgagaatcaagctgggcccatagaaggccatgtatgacaccgtgaagaacactgtggcaccaacgtgcctctatgatgtctgcgatctacgacgagga

SEQ ID NO: 80795 - DNA, 437 bp, Zea mays
  Clone ID: LIB3088-021-Q1-K1-G7
atgattcttgcataagctggggtgtcgcccagaatggagagcttggttatgggcctaaggggcagaaatcatgggcaaatgccaaaaaggtggacattcttgagggcatgcatgttacaagtgtcggctgcggatttggactgtctctgattgttgtggacagagcaaatgttggtgaccgacttggtcagctggaaatttatgatggtgacaccggtgctgaagtagagaaggtggaggtgcaagtaaccaagaaggcatctgccagcaccaactcacgtgccaacaagcgcaagaaaacgaaggatgtttctgaatctgagtccgaagaggatgatgaagaggatgaaagcggagacgatgaaaatggtggtgtagaagagtcaaagggcaggcgtggccgtaaaccctgcaatagagggagaggcaggggagcc

SEQ ID NO: 80796 - DNA, 417 bp, Zea mays
  unsure at all n locations
  Clone ID: LIB3088-021-Q1-K1-G8
cccacgcgtccggcaagcaacggtaagataggtgctcttacagacacagccggctgagtgtgagctactaccggacagcaggaggccacggacgtagccggcggagattatacaggaatagtagctcattaggttatgttagatgactatatcagccccttcccaaccgtcaataatgttgggagttttgacatctccgcggcgctgcgggttgtgcaaggcaggcaggcaggcagtccattcttcgcttggatgccatggcgcctggtgtaaccaactggtagcgtgtgaggaggcttcgttgtattgactagtgcatatttctgggcaaaacagatgcgtttggttgcacacatgtattcttttatcccttttcctctttgatgatgagtatagcagaaaaaaaaacagttnaat

SEQ ID NO: 80797 - DNA, 354 bp, Zea mays
  Clone ID: LIB3088-021-Q1-K1-G9
gaggagctgagagccctggagtcaaagtatgtcggcgctgaaggttacagagaaatggggcgaaaatgatcggtagctgacaagcgggcgaaggttgaggctctgaggagccgtgccgacgaggagaagatcaaatacgagaagagcatcggggtcaccagagcaatgaccctgaataacctgcagactggcttgcctaacgttttccaggcgatgacgggcttcgccagcgtgtgcatggaggcatttgagtcggtgtacaacttcaagcggagctcggacccgaagaggctgctgacctgaagcaatagtggataaaatggatacagtcctagggttttagtaacaatgata

SEQ ID NO: 80798 - DNA, 274 bp, Zea mays
  Clone ID: LIB3088-021-Q1-K1-H1
ggcgcccacgcgttcgtagcacctctcattgcttcactgattcatcaactacgattacccagagtgtggtggcgacacaatcatggcgctgcccgtccagccaatcatccgtgcccgagctcactttcacggttagcatgtcatcctccagcaacctaatacccttgccctaaagttctgtgcctacatctacgtaccgatggatctatcctttgtacccaagcgcctgtaaacaacatacaccgtaatgtacacaaatatctacattatttct

SEQ ID NO: 80799 - DNA, 397 bp, Zea mays
  Clone ID: LIB3088-021-Q1-K1-H10
caaagaaccaaagctagagacaaccgctgcgtaaacgaatccatcgccatggcgtctggtctcgttgcggcggcggcctgctcctcctccctctcttcagcgtcccccctcgctcgcctaatctctcgccgcggccttgccggtgccgcagacggccatgggtctgcgaaggtgcccttgtggaaagatccgttgagcccgagcaagtggaaggaagagcactttgttctagcaagcctctcaatgtggggggttattttttatggtggttacaagctttttagtggaaagaaggaagccaagactgatgcgggatcaccacaggcataggtggcggagatggagttgtacccatatctgaggcccggcaacaatgttaaaataaaggaatgcttta

SEQ ID NO: 80800 - DNA, 290 bp, Zea mays
  Clone ID: LIB3088-021-Q1-K1-H4
gcgcggagccgttttcgcatcaattcctggcccgattatctcggctatatactgtcttctctgcgcttgggttgctgcgtagcgtgaagcagaatttaaagattgcatcttttttatatatatagaatcgctaaattatgaaaacgctatgtgtgttctcctgtgcaaacaggtaccgcgggtgttggtttcctgcagttctgcaacctgaacagcttccgaacaaaattcatcctgtggttctctttgtctatgggtttgtcggtgccacagtatttcaacgagtacac

SEQ ID NO: 80801 - DNA, 273 bp, Zea mays
  Clone ID: LIB3088-021-Q1-K1-H5
aaaaaaaaaaaaaaaaaacaaaaaaaaaataaaaaaaaaaaaaaaaaaaaaaaagaaaaaagaaaaaaaaaaaaaggaaaaaggaaaaacaaaaaaaaaaaaaacaaaaaaaaacaaaaaaaaaaaaaaaatctaacaaaaaaaaaaaaaaatataatctaaaaccatattaaaatgaaataataccatacaataaataaacacatgatatccgtaatacttatataaaccagaataaatcattatttataaagcatcataataactatatat

SEQ ID NO: 80802 - DNA, 51 bp, Zea mays
  Clone ID: LIB3088-021-Q1-K1-H6
tctttcgacaacacatactctcactcatatttcgatttcaacatctactaa

SEQ ID NO: 80803 - DNA, 434 bp, Zea mays
  Clone ID: LIB3088-021-Q1-K1-H7
cggacgcgtgggcggacgcgtgggttcccagcgaccccgcccgcccggaggcgtcgcacgtgcacgctgcgggagccgccaagcctctctcgtgcggcaagcaccacacagacacccgatggcgctcctgctgctgcgcggctgcgccgcgccgccagccgtccacgcggccccggcggggtcccggctgctccctccggcgctgccgcggcggcggctcgtggccgtcgcctcttcggcctcccccgcgccgtccggagaggtggcgtcgtcgtcccaggacggccgcggctacgggaccgtgggcgggcccaacggccacgccatcgctcccgccacagacaccaagtccaccgtcgtcgagaccaccgtccagagggtgatcttcgacttccggttcctggcactcctcgccgtcgccgggtcacttcgcc

SEQ ID NO: 80804 - DNA, 381 bp, Zea mays
  Clone ID: LIB3088-021-Q1-K1-H8
cccacgcgtccgcccacgcgtccgcccacgcgtccgcccacgcgtccgcttgcgacctcgtgccaggttcagctggccagatcggtggcatgcagcagccactgcaaccacaagttaaccacatgggagttccacaaagccagccaatgtatagtaaccaaccaatgcgacccggtcaggttgccgtcacaacacagatgcagcctggcttcggaaaccagcagttcggttcgctaccaccaacatccatgctgggcatgcaattcggtggcatgcagcctccgcagatgtatggcggatcgcagccagtcatgatgtacccgcaacatatggcagtggcccagtatggagcaatgccggcggagcagccgacgtatggtg

SEQ ID NO: 80805 - DNA, 255 bp, Zea mays
  unsure at all n locations
  Clone ID: LIB3088-022-Q1-K1-A12
cccacgcgnccgggcgacgcngaaccggaaagcaaagaaccagacacgggggccaaggcgggaggcgcgcagcgaagcccgggcacggcagaacgcggcgccgaagacanggcaagggcgcccngagaacgnggaggcagcgcagaaggcccngcgggngcgcgcaaaggccaacgcgggggcccagcacggncgcnacaccggngagggcgagagcgangaagccaagaaaggcangacccagaagggcnacac

SEQ ID NO: 80806 - DNA, 221 bp, Zea mays
  Clone ID: LIB3088-022-Q1-K1-A2
acgtctgatagcgagagcaaaaaaaaaaaaaattagattaaaaaaaaaaaaaaaaaaaaaaaaaaaaaagaaaaattaaaaaagggaaaagaaaaaaaaaaaaaaaaaaaaaaaaaaaaaaaaaaaaaaaaaaaaataaaaaaatactataatataaattaaaataaattaaaatatataaataaaaaaataataaaaattaaataaattaaatttataat

SEQ ID NO: 80807 - DNA, 281 bp, Zea mays
  Clone ID: LIB3088-022-Q1-K1-A4
gaattttcggctcgacggacgcgggcgttctcttccaaattctacaacgcgttgctaaaggtgtatgctgatcacaacctcttatagaagggtgaggaacttgcagggcggatggatgataaccgtttcatgttttgtgccccaactctggatgcactatgtaagctatactttgaggctttataggttgataaagctgtattcctaattcacaatctatctatacataaccacattaagcctatatacaacacatacattactctgcttgacatcttctt

SEQ ID NO: 80808 - DNA, 420 bp, Zea mays
  Clone ID: LIB3088-022-Q1-K1-A5
tggcatcctgaaggaggatcttcctaggttcgagctagaactcgaattgaagagtgccgagcgtgagctgactgaggtcaagagggaatgtgtagaggcaatggagactcaactcaagagggaggagttccaagatgaggagatgcctgatgtcaggaaactggacatccgaaacttcctgtaggcctgatcgacgataacctttgaggcagtcatcccgccgcgatgagggccaagtggaagaagaagcggatgaggcggcttaagaggaagcgccgaaagatgaggcagaggtccaagtatgcagattcatggagtgtccccgcctggagtctctctgtgatcggatgttgattactgagtaattttagattttgttactaagacagtcatgtatggatcataaatttcttgcatttg

SEQ ID NO: 80809 - DNA, 438 bp, Zea mays
  Clone ID: LIB3088-022-Q1-K1-A8
gcaaagatcatcacttcacttattttccttcttatttatcctgggattgaatttctgcagctaaaaaaaatttgtaagtcatacaataaataattgttctgctggattgtttgttcagacaaccaagataactgctgctatcatgagtttttttatgaattgaagttgccatgcatatagcaactaatctggcattaagcaggtatatgacactgcattagcccgctacagacatccaaactcttagcttccaaatgttattatttctatgtatgctatattcaatgtgagctagtttatctagtagttcacacccggcgtctttaccatttagcttgtgtggttaattagacctagtgaccttgtatggatgaaaacggtcggaaacggtcgataaacgctaaaaccgtttcaattttcattttttattgaaaatga

SEQ ID NO: 80810 - DNA, 307 bp, Zea mays
  Clone ID: LIB3088-022-Q1-K1-B1
acccactctgaactcaaaaataatataaatttcaactaaatcttttgattttattcctataattttatatacagtcatcgtttatatttaacagtagttattgcccaaatatacttataaatttcaacccttatctattttaacttttataaaaaaactattactaactacattaatccatttttctaatacaaaattccaacaatttctctaacttaataattaatttctattccaaaattctaatcattttcttactttataaattttttaaaaacaccacttaaatttctttacaatacccttt

SEQ ID NO: 80811 - DNA, 399 bp, Zea mays
  Clone ID: LIB3088-021-Q1-K1-G6
cggacgcgtgggcggacgcgtgggcggacgcgtgggcggacgcgtgggaaaggtgtttgtgcatcgcggcggggacaagggggcgacgaggcaggcggagcgggcggcgactacagcggcagcagatctcacggaatggcggcgaaggcaatctcgagccccgtgccggtggagtggtacccgacgctggccgtcgtcatggtatccgtaggcctcatgttcaccgcctccttcttcatttatgaagcaacttcatcccggaggagccgtagcctgtcaaaggagatcgcaacagcagttgttgcttctgttttcttgggctttgggtctctgttcgtgcttcttgcaagtggtgtttatgtctgatgactggctatgggccgtgtgtgcttgtgttct

SEQ ID NO: 80812 - DNA, 415 bp, Zea mays
  Clone ID: LIB3088-021-Q1-K1-E2
cggacgcgtggggttctagatcgcgagctagaacaatagacttcccatggtagctattgtgttgaggatgtgcgaaagaggcactgcagagtctgagaagtgagagaaataaatgacaagtgctgtttaccgctcacccaattttaaccaatgccacggtgatacgattatctctgctaaagggataattgtttcaactaaaccaaacaccacagttggaggtcaaatccttggaaggcaatattgtgaagttattgtaatttgtgtgctaaaacgagatacagttttgcctcgccctggagtgatgtcgttgtggtgcttttgtgactgatcatctctggagcttttgtgaatgatctagctagatatctgtaaatgatctagttgtgaatgatattataattgtgatgctttt

SEQ ID NO: 80813 - DNA, 146 bp, Zea mays
  Clone ID: LIB3088-021-Q1-K1-E3
gcgttttttttatcaaaaagatgatttctcgattaaagcaaccggagtaacactgtaacagcgaaatatttggggacaaaagggtatactgtgtgtgagcaaaaagggtgtattgccttgtgcgtatgttggcgcacttcatgctg

SEQ ID NO: 80814 - DNA, 367 bp, Zea mays
  unsure at all n locations
  Clone ID: LIB3088-021-Q1-K1-E4
ggagagggcaaggatgctgctcctgagctcccccttcgtgtccgtgtcgccgccgccggcgccgctcagctccgatggcgcgtcgcccggcgctgcggatcgaggcggccaggcagctgacggggcgggtggtgacgaccaaggcgaacaagacggtcggngtggaggtggtgcgcctggctccacaccccatgtacaagcgccgggagcgcatcaagaagaagtaccaggcgcacgaccccgacaaccagttcaaggtcggcgacgtcgtcgagctccaaccctaccgtcccatctccaagaccaagcacttcctcgccatcccgctcccgccccgcgacactcgccgcatgtctcagctcctacc

SEQ ID NO: 80815 - DNA, 440 bp, Zea mays
  Clone ID: LIB3088-021-Q1-K1-E5
gcgagccaccgccccgccgtcgcttgaggtagacaccaatccaccgccatggggcgtatgcacagccgcgggaggggtatgtcttcatcggcgctgccgtacaagaggactcctccgatctggctcaagacagctaccaccgaggtggaggagatgattaccaaggctgcgaagaagggccagatgccgtcgcagattggtgttctgctccgtgaccagcacggcatcccgcttgtcaagagcgtgactggtagcaagatcctccgcatcctcaaggcccatgggttggcgccggagatcccggaggatctctacttcctcattaagaaggcggtggcgattaggaagcatttggagaggaacaggaaggacaaggactccaaattcagactcattcttgttgagagcaggatccaccgccttgctcgctactacaagcg

SEQ ID NO: 80816 - DNA, 397 bp, Zea mays
  Clone ID: LIB3088-021-Q1-K1-E6
cccacgcatccgacaaggcactctagagttcaacaccaatccatcgccatggggctcatgcacaggggttggggggatatgcataaatatgccctgccgtacaagaggactgctcccatctagctcaagaccgctaccaccgagctggactaaatgattatcaaggctgaacacatcgaccacatactgcaggatatcggtgtactcctccgtgaccagaacgtgatccatcttgctaagagcatgactggtagcacgatcctacgtatcctcaatgaccatggacttgcgccttaaatccctatcgatctatacttactcattaacaatgaggtgatgactacgaatcatttgcagacgaacagcctggacatggactccatattcacactcattc

SEQ ID NO: 80817 - DNA, 299 bp, Zea mays
  Clone ID: LIB3088-021-Q1-K1-E7
gttctagatcgcgagcgccgccctttttttttttttttttttttttttttttggttttggttttttttttttgtgttttttttttttttttttttttttttttttttttttttttttttttttttttttttttaaaaaaacctttttggaaaaaattttaatttttgggaaaaattccttttggaaaaattttataaaaaaatcaaaaatttcttggaaatgaaaaatttttaactttggaactttaaaagccaatttaaaaaaggggaaaactgggtggtttttccccttttatcccc

SEQ ID NO: 80818 - DNA, 425 bp, Zea mays
  Clone ID: LIB3088-021-Q1-K1-E9
gattcccggtcgcgcacgcgtccggccactggtgtattgaaagttttgaataatatggcacgtttggatataacccttttgggggacatgctgtctagatcagatctaaagatggagttcttccatttaatcagcttccttttgagtcattgcatgaacaaatggagagtgccaaacgatcaggttggtttgctgcttctagagtctctgctacttcttggctacttttctttgttccatgctgggaaccaagctgttcttcggtggggaaagagtcccactatacttcacaaggtgtgcgacctgccatttgttttcttcagcgaccccgagttgatgcccatcttggctgctagtttgatcgctgtttgctacgggtgctatcataaccctttgcgtgtacagtaagaaataagcacggatat

SEQ ID NO: 80819 - DNA, 252 bp, Zea mays
  Clone ID: LIB3088-021-Q1-K1-F1
gtcgaccattccggcgccccgcactaggtgtggctgttgttgctgttacatctgactggactgtgggattagcgacgagtacgtgactgaaaaggttccatttgatgaggcgatttgaagaacggagtatataaacctgtacataactctaggtcatgcaatgcaagtggttgcgatcgtctgagtatgtgcaggtgcagcatttatgttgttggtacttgggtgatgggtagcaggcatatgcttgggtag

SEQ ID NO: 80820 - DNA, 183 bp, Zea mays
  unsure at all n locations
  Clone ID: LIB3088-021-Q1-K1-F12
acgcggncgcccacgcgnccgcccacgcgaccggaacagagaagggagagggatacgagcggcgacgcgaaagagggcgcaggaanaaggggggaggcgngaggaggaggactggcgggagcgcaaggcacaagncacaagccggggagcaagaggaggggaccagaagcgangaggaagaca

SEQ ID NO: 80821 - DNA, 150 bp, Zea mays
  Clone ID: LIB3088-021-Q1-K1-F2
atttctcgggtcgacgcactcttgctataaatcattccgaaaatcaaaactagattttgtttttatttatctataatataaatgggatatagtattatggactaggggttaacttaaaaatattcattacataatccaatataattaact

SEQ ID NO: 80822 - DNA, 429 bp, Zea mays
  Clone ID: LIB3088-021-Q1-K1-F4
atccaattgggtgagggctccgctggtcaggtcacaaggaacatgcttgcaaatgagggtgtccgttctttctacaagggtttgtctgccggattgctgaggcaagcgacgtacacgactgctcgtcttggatcctttagggttctaactaacaaagcagttgaaaagaatgaagggaagccattgcctctaattcagaaagcttttattggtctgactgctggagcaattggtgcttgttttggtagtcctgctgatctggcactcattagaatgcaagccgactcgaccctgccagctgcacaacgacgcaactataagaatgctttccatgcactctaccgtatcagtgctgatgagggagtccttgcgctttggaaggtgcaagtccaacttgtgtgagagctatggcactcaatatgggtatgc

SEQ ID NO: 80823 - DNA, 428 bp, Zea mays
  Clone ID: LIB3088-021-Q1-K1-F5
atatgaactgaaaagggttaacgcctttttgttttcatgtgtgacgagaaacaaaacccgatcgttctagaacgtattttcttacttctgcaacgactcacatataatttctcaggttgctggtgctgcgattatctatgaggtgcaaagaagtgctaggtcagaagccagaaaagaggaggcccgtcgtctggaaattgaggagataaagaaaagggaggagcaactagcgctggaagtacaggtaatgaaacacaagattagcgagatggagcggcagtactcgaagtggacccttcccgggcttcgcggcttcggcactgcccaggcggcggcacagcctgctggtactcagcacccaacagctgcgtgattgctctacttctgcaactgtcgacagctcgcgatctggatggccgactgcagac

SEQ ID NO: 80824 - DNA, 432 bp, Zea mays
  Clone ID: LIB3088-021-Q1-K1-F6
tgaagatgactggagccatttctcttgaccatccagatgagcgtgtgttggggctgtaggttatccgatttgcgtgaggtggttgaagaggcatgcacgaatctgcttccaaatgttgtgtgtgaatacttgtacaatctatctgaaatgttcacaaaattctataccaactgtcaggtggtcgggtcaccggaggagacgagccgactgttgctttgccaagcgactgctgttgtcatgcgacagtgcttcaatctgctagggatcaccccagtctacaagctgtgatcggctgcatgtttgaagtttgatttatacattcaacatcgctttacgtagaaacccattcatcatggatgcagttttggccttgtaacctaagtgaggcagttaacagactataatccatctcccttgttgaaaatagaagca

SEQ ID NO: 80825 - DNA, 334 bp, Zea mays
  Clone ID: LIB3088-021-Q1-K1-F7
tgaagatgactggagccatttctctggattatccagatgagcgtgtgttggggctatagcttatccgattagcggatgtggttgaagaggcatgcacgaatctgcttccaaatgttgtgtgtgaatacttgtacaatctatctgaaatgttcacaaaattctataccaactgtcaggtggtcggctcaccgtaggagacgagccgactgttgctttgccaagcgactgctgttgtcatgcgacagtgcttcaatctgctagggatcaccccagtctacaagctgtgatcggctgcatgtttgaagtttgatttatacattcaacatcgctttac

SEQ ID NO: 80826 - DNA, 145 bp, Zea mays
  Clone ID: LIB3088-021-Q1-K1-G1
gcgcccacgcgtgcgcgcacacctacattgcttcatcttttgaagaataccgatctttacagggattttgttactcttccacggacaatcactaactacacaaccccttctacacctaccaagaacagcttgtgtacaagatcat

SEQ ID NO: 80827 - DNA, 382 bp, Zea mays
  unsure at all n locations
  Clone ID: LIB3088-021-Q1-K1-G2
cggacgcgtggggaagcttgttaagaggcttgccaagaagtaccatgctttcttggcatgagaggccatcatggagcagagtccccgtctccttggtcctggtctcaacaaggcaggcaagttcccgaccctggttactcaccaggaatccctcgaatccaaggtgaacgagactaaggcaaccgtcaagttccagctcaagaaggtcctttgcatgggcgtcgccgtcggcaacttggcgatggaggagaagcagatccagcagaacatccagatgagcgtgaacttccttgtttcccttctgaagaagaactggcagaatgtgagatgcctctacgtcaagagcaccatggngaagccatacagggtgttctaagtatgc

SEQ ID NO: 80828 - DNA, 369 bp, Zea mays
  Clone ID: LIB3088-021-Q1-K1-G4
gcgcccacgcgtccgagcagatcaggccagtttgcaagagtgccgtgatcacggtcgatcaggataagtgggctggggcgaaggcaactgacaaggtaatgagcttccaccgcgacgccaaaaatgcaaactttttgatcaaggagggtgacaaggtgaggaagctcgcgctgcagtacgtcgaggcatctcagcagaagatcagttgagaccctttaccggatttgaaaaatgtgatcacaatagctgccattgtttcctcgtgctggagcaagcaatccatgtaaatgactgggtgtgcggatcacttggtcaacaaccgtgtacaggccaccctttccgtaaatacatctgcttatgcattttgac

SEQ ID NO: 80829 - DNA, 304 bp, Zea mays
  Clone ID: LIB3088-021-Q1-K1-E12
agctgcggcgtcatcggcccacctgactcgacaggctgcagctacgaccccagccaggggctagagcaacgagaacgaatgagctagtagccgaccgcgtatctccatcatggccgagctggtcgcgaggcacggacacgagctgcagcgggacagccagagcaccggcaggcgcatcgcggtgggctgcatgccataccgcgtgcggtgcgactgcaagctggaggtgctcgcgatcacatcccagaaggggcacggcatgatgttccacaagggctgatgcgaggtggacgagtccatggac

SEQ ID NO: 80830 - DNA, 193 bp, Zea mays
  Clone ID: LIB3088-021-Q1-K1-G5
aaaaaaataccaaaaataaaaaaaaaaattttcaaaaaaaaaaaaaaaaaaaaagaacaaggtcaaaaaaaaaaagaggaaaagaacaaacaactataaaacatcatcactctaaacactcacgactctcaatgacaatctatctaatcatatacagaaaatatcttcaacaacctcagccaccctctactaa

SEQ ID NO: 80831 - DNA, 452 bp, Zea mays
  unsure at all n locations
  Clone ID: LIB3088-005-Q1-K1-F3
cccacgcgtccgcccacgcgtccgccactgtccctgtcaagaccgctgaggctattgagaagatcttgacccacaacagcaagggcatcaactaccagatcctttccaacccagagttccttgcggagggcactgccattgaggacctgttcaagcctgacagagtgcttatcggtggccgggagacccctgagggcaggaaggccgtccaggctctcaaggatgtgtacgctcactgggttcccgaggacaggatcctcaccaccaacctgtggtctgctgagctctccaagctcgctgccaacgcgttcctggcacagaggatctcctctgtgaacgccatctccgccctctgcgaggccaccggcgcgaatgtgactgangtggcttacgccgtgggcaaggacacgaggattggccccaagttcctgaacgccagtgttgggttcggt

SEQ ID NO: 80832 - DNA, 444 bp, Zea mays
  Clone ID: LIB3088-005-Q1-K1-F4
cgaagatattgttccttcgtcacacaactgtgatattccgcatgtgaaccgtactgagtgccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaacgatgttggccccaagtaacttccctgccttggaatactgtatctcaaaacctaaatcgaaaaaagaagtgtatcaaggattgctacagagacattcatctggcttgagctggcttttgctattgcaaacacaagtgcatggatcgctgggtgttgcaccgagtctgcattatctgtggttacattctggaccct

SEQ ID NO: 80833 - DNA, 267 bp, Zea mays
  Clone ID: LIB3088-005-Q1-K1-F5
cccacgcgtccgaaaaaaaaaaaataaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaacaaaattttttatggaagaaaatacctattataacacaaaatgataaaaattatataatagataattttcataaattggaataatttgaaaaggattctaaaa

SEQ ID NO: 80834 - DNA, 402 bp, Zea mays
  Clone ID: LIB3088-005-Q1-K1-F6
aagaattcaaagatattttttcaccatttagtcaccgtaaaggaagctcagacttatgagagaccaccaaactggaaggatgaagggatttggttttgtcaaatattcatcgcaagcagaggcagagaaagctgtcaaggcaatggatggcaggattctacgtggaagattgatctttgtggagatggcaaaaggacacgaaagcaagtaggacaccctccccacgagaggatttcactgaacatgaaacatgagagcgccatcagcttatgccagatggcaaatatcccaaattctcaattgatgttgcaacttatatacaaagcacaagttaattttagctagcttatctttgataacactgctaccttaccatctgaatggttgccgtgtattggtatc

SEQ ID NO: 80835 - DNA, 318 bp, Zea mays
  Clone ID: LIB3088-005-Q1-K1-F8
gtcagctaacttggggaacttgaaactggatggttcttctgaaaactatgatgaaagcagagagggaaatgtttatgactttggacacactggaagaacgcttcaactggcttacaatgaaacatgattgggtcactaggatgattcactaggatctataattttttgtagcactatgtcccattttcagtgctattatgtatctgtttaatcctttttactgcggtttgaacttgttgtgacattattgtggatggattgtacctccatctattattgcaacatgtttggaacttgttatgagaattatgtttagct

SEQ ID NO: 80836 - DNA, 242 bp, Zea mays
  unsure at all n locations
  Clone ID: LIB3088-005-Q1-K1-F9
cccacgcgtncgnccacccgtccgcggccttgtggggcaaaatcgtgttaaactcgtgggcgtattgcgttgggtgctgtacgagggcatcacttgttgttctatgcccccttccctactagattttcttttctaccctgngcctggagagatgtttctgtcatgactgtcattgtggatctcgcgatattgttatattgaagctnttgtgcttgttcaagaaaagaaaatgttgttgcgat

SEQ ID NO: 80837 - DNA, 232 bp, Zea mays
  unsure at all n locations
  Clone ID: LIB3088-005-Q1-K1-G1
cccacgcgtccgcccacgcgtccggtgctgaagcaggtgcacccggacatcggcatctccgccaaggccatgtccatcatgaactccttcatcaacgacatcttcgagaagctggccggcgaggccgccaagctcgcgcgctacaacaagaagcccaccatcacctnccgcgagatccagacctccgtgcgcctcgtgctccccggcgagctcgccaagcacgccgtctctg

SEQ ID NO: 80838 - DNA, 444 bp, Zea mays
  Clone ID: LIB3088-005-Q1-K1-G10
cggacgcgtggggccgtcttccactgcgcttgagtccaaggtcttctatctcaagatgaagggtgattactacagatacctggctgagttcaagactggagctgagagaaaggacgctgctgagaacacgatggtggcatacaaggctgcccaggacattgctctggctgagcttgctccaactcaccctattaggcttggactggcacttaacttctcagtgttctactatgagattctgaactcacctgatcgcgcctgcagtcttgcaaagcaggcttttgacgaggccatctcggaactggacaccctgaacgaggagtcctacaaggacagcactttgatcatgcagctccttcgtgataacttgaccctatggacttctgacatctcggaggaccctgctgaagagattagggaggcacccaagcgcgactcgagtga

SEQ ID NO: 80839 - DNA, 396 bp, Zea mays
  Clone ID: LIB3088-005-Q1-K1-G11
cccacgcgtccgcccacgcgtccgtgaggtgcgtggccctcgagagggatctctccagctgcaggcaggaggcccaccgccttgccaccgagaagcaggagctggccgggcagctgggcacagagaggcagaagatggatgagctgaagcaggatatccgggtgatctgcggcgacttgctccagcgggaagggcagctcacgtcgatttacaccaagtccaaggccatcatagagagctgcaaggcctcccaggtagctactctgctttgatggtttcaatgaccgctgttggcttgtgcattttttatacataaaaacagaaggacagcatttttatgttgagattatatccttcgttggcgttgcaattataatttcatcctcagtttttttt

SEQ ID NO: 80840 - DNA, 446 bp, Zea mays
  Clone ID: LIB3088-005-Q1-K1-G12
catgaaatgcagcatctgtcaggaagagtacgcggagggcgaagaggttgggaggctgccatgcgagcaccggtaccatgtgtgctgcataggccagtggcttgggcagaagaactggtgtccagtatgcaaagcgtctgccgtgccttccaagggctgaagcattggggatgctggaaaccccgttccggattacaaaccatccttgcttttgtctacgtacattgttcttttccctatatgcattagatatagatcatgtctagatgtatgacgctagaacagcttgcgatttgggaggaagctaagagagtaatagttagctggttaataatagttcatagctaatatttgctagataactattacttggctacctattagctgtgcctttcacattgtggtacaggacaaatgcttgtcagatcgtgaacaaccttataact

SEQ ID NO: 80841 - DNA, 195 bp, Zea mays
  Clone ID: LIB3088-005-Q1-K1-G3
cggacgcgtgggcggacgcgtgggtcagagtcgaaactcgaaagtttgcatgcagttggatgtgggcaattaagagtgaagcggtttgtgtttttgatgtcaagacctcatatcgcgcggagtagctaagctcgaccatatattggtcgccacgtatgatcctattttatttaagtgtgttggcagttttatcct

SEQ ID NO: 80842 - DNA, 356 bp, Zea mays
  Clone ID: LIB3088-005-Q1-K1-G4
cccacgcgtccgcccacgcgtccgctttcatcaattttccttggggagttgcctacgccagtgggttgtgttgtctcttcttgcgattgttggtggtgtagctttggcatcccttactgaggcctcctttaactgggctggattttggagtgcaatggcttcaaatgtaaccttccagtcaaggaatgtgctaagcaagaaacttatggtgaagaaagaggaatctctcgacaacattaacctattctcgatcattacagtcatgtcattcttcctgttggccccagtaaccttacttacagaaggtgttaaagttagtccagcagtgttgcagtctgctggtttgaacttgaaac

SEQ ID NO: 80843 - DNA, 354 bp, Zea mays
  Clone ID: LIB3088-005-Q1-K1-G5
ctttgctgactacgattcatctattgttaatgagaacgatggcaactcgcaggttgattgggaatcaaacaggggcgactcaggtttttacagcaacgacctgatatcaactaaacagagcaatgtcagagacattgtcaactaaacagcaccagcagcataagatgaaactgtctttgaagagatatggtggtctgctgaagaagaaaagcgaaaattagcataagaaccatttgatcatatgctttgttctattctttgatgcatatttctttggcgagccatctatttcccaagtcttcacatatgttatggaaagcaaatgaaggatgcttcaatgaagaattcagaatg

SEQ ID NO: 80844 - DNA, 446 bp, Zea mays
  Clone ID: LIB3088-005-Q1-K1-G6
aactcatcctgtcggacgaagatgtcgtgcgcttccagatcggggaggtgtttgctcacatgccgagggacgacgtcgagactaggctggagcagatgaaagaggatgcggctaagaagctggagaggctagaggaggagaaggaatccgtcctcgcccagatggccgagctgaagaagatactgtacgggaagttcaaggacgccatcaacctggaggaagattaagagtagtactggagttgtgacaacgtggctgtctcgttctagttcaggtcctgtttttgttcccctgctccccccacagaagcgcttggcccgctcgtgtaatggaagcttgagtctctcagtctttcagaagctcttttcaccaagaacccagaatagttttcattctgcgggtttatacggattgaagctaatggcgctgagcccatgaatcctttt

SEQ ID NO: 80845 - DNA, 376 bp, Zea mays
  unsure at all n locations
  Clone ID: LIB3088-005-Q1-K1-G7
tggacgacgacatggatgatcttgattccgactcagatcttgatgttgacagcagcggtgagattgtgtacgcaatgtgagtaacatctcagcagccatctcagcagtcaaccaaggaaccaatcaggcatgggatgccctgttgtatactctggcaaagggcatgcttccttttgtgaaaaacatccatgtagttttctcaaggaatcgcaatgtgttctgtggaacacatatgttgtagtcaaactcgggttactcagcttgtaaaactagcctnctcttgcttcctggttactgggctttggatactctcaggcttcgacttgtgtgttgctgttaaatatgtataagaaacttctactcaggttgatctgtg

SEQ ID NO: 80846 - DNA, 216 bp, Zea mays
  Clone ID: LIB3088-005-Q1-K1-G8
ccgcattcgtgtacctgtatctttacttatgatgatgatgatgtatttccttcgtgtctgatagtaagtaattcacggccaggtcattgtagactctggtaaccgtttcggaaaatctagtgctatatctggtggatgattgtcaaaaactatgcaaaaaggcaatgctaacttttgtgaaaaacatacatgtagttttatcaaggaaataaaaat

SEQ ID NO: 80847 - DNA, 323 bp, Zea mays
  unsure at all n locations
  Clone ID: LIB3088-005-Q1-K1-G9
cccacgcgtccggcccattgcaaaaggggtgtgaccacattgccaggatgcaaaaactgcacgacgttttgtccactgccagtaatcctcctctgaatctctggtcaatttatagttcaaagctattgttgtaattctgtagtctgcactctgcacaatatatntcttagtgcccagttccagatcacgtggtgtgattatgcgtgggtatctagaccatatgtaaataccaagaagttaaacaaatgtattatagcgtgcttgtttgaggaacaaaanaaataaaataactaataacataaataataaaagaactatttact

SEQ ID NO: 80848 - DNA, 275 bp, Zea mays
  Clone ID: LIB3088-005-Q1-K1-F2
caaatttgcttttttatactatacctctcctactcttaagagacctatttcaatgggtgaaggccctacatttctccaatataatccacaacatttttcacacagtattatactttatctccattttctatccatatacctatacctcttctcaagacatatttcaaaaataaacccaattttataaattcaacttattaaacaagtacaattacctctaattcttattaaccttaataattgaaccctatatccttttcaaatactacaaaaca

SEQ ID NO: 80849 - DNA, 414 bp, Zea mays
  Clone ID: LIB3088-005-Q1-K1-D9
attggattgggccaaggatggatttcattcctggtgtcgatggtcctagtgagggtgtacgccgggtgctggcttgcttcagtaacaatctgctccgccgagagcctttgaagcttgtcgatgggggccagtctcagagaacctttgtatacatcaaggatgccatcgaagctgttgtgctgatgattgaaaatcctgctcgagccaatggtcacatcttcaatgttgggaatcctgacaatgaggttacggttagggagttggcccaaatgatgacagaggtctatgcaaacgtctcaagagaggcgccgctggatgagcctatgatcgacgtgagttcgagtcagttctacggtgaaagatacgatgacagtgataagagaattcctgacatgactataatcaacaagcagc

SEQ ID NO: 80850 - DNA, 437 bp, Zea mays
  Clone ID: LIB3088-005-Q1-K1-E1
aaattccccagccttccgccctcatttgagcagacacctaaagccgtggaggagctcaaacttgcaagggacatttatgagcatgctgttgttttgagtgtgaaacttgaggaccaagatgcatttgaacgtgatttctgtcagctaaagccttattacatggatacatgtggcataattcccccctcaccagaggagtacccaattttgggactcaatcttctgaggctgttggttcagaatagaattgctgagttccatactgagctggagcttttacctgtcaaggcacttgagcacccttgcatcaagcatgctgtagagcttgagcaatccttcatggagggtgcctacaaccgagtgttaagcgctcggcaagctgtgccacatgagacctatgtttacttcatggaccttctcgccaagacagttagaga

SEQ ID NO: 80851 - DNA, 326 bp, Zea mays
  Clone ID: LIB3088-005-Q1-K1-E10
tgcacagcggctgctcgccggcggtgcgtgtgatgacgtcggagctgcttaagatcttcagggtgaacggcaagagctgcgtggcaaggtacgactccaagactagccacatcatgcccttctgattctcaacgccatcggtgatacaacagtggaaccagcatttgtctgttacccttttccagtttcgacaattatttgaagtgattcgttggaagtgcatacagtgggaaaaaatacagaatgactcttggagcaacacacaacttgtatatgagtagaggatttcggtcgaaagaaatcaatggatgaaacaaattcagctt

SEQ ID NO: 80852 - DNA, 327 bp, Zea mays
  Clone ID: LIB3088-005-Q1-K1-E11
cccacgcgtccgcccacgcgtccggcccacgcgtccggaccagaatcgcatttgcaatctagtagatgtcttctaccggcactatatatttccttttgtttgatgtgtaatgatgttactgttcaacgcttattaccctactatactgttggatgttctttggacctaaaaaaaaaacaattacaaattcaattattatatgtaataattcattaaaaatgcatacaaataagaaaaaatacagaatgtcttttggagcaacacaaaattttgtaaatgagtaaacaaaaaaaaaggggcggccctttttagggtccaacattttct

SEQ ID NO: 80853 - DNA, 444 bp, Zea mays
  unsure at all n locations
  Clone ID: LIB3088-005-Q1-K1-E12
cccacgcgtccgcccacgcgtncggccatggatgtggatctgtggatctccaaggtcaaggagggccagcacctcgccgagcacgagcttcagtcgctctgcgaatacgtgaaggagatcctcatcgaagagtcgaacgttcaaccggtgaatagccctgtgacggtttgcggtgacatccatgggcagttccatgacctgatgaagctcttcgcgacggggggccacgtcccagagacgaactatattttcatgggtgattttgtggaccgtggcttcaacagtctggaggttttcaccatcctgttgctactaaaagcgaggtatcctgcacacataacccttctgcgtggaaatcatgaaagtaggcagttgacacaggtgtatggtttctatgatgagtgtcagaggaagtatggcaacgccaatgcatggcggtattgc

SEQ ID NO: 80854 - DNA, 449 bp, Zea mays
  unsure at all n locations
  Clone ID: LIB3088-005-Q1-K1-E2
cccacgcgtccgcggacgcgtgggcgcggctgcagctcagcagctccagacctcatcagaggcacctaccacaccgcccgccgccgatcccgtctcctccccgctgcggagcgtctccagccctgcccggtgcccacccagatggcaaacgcggcgtcagggatggccgtggacgacgagtgcaagcgccggttcctggagctcaaggccaagaggacgcaccgcttcatcatctacaggatcgacgagaagaagaagatggtggtggtggagcaggtgggcgagcccgtgctcggctacgacgacttcgccgncagccttcccgccaacgagtgcaggtacgccatcttcgactacgacttcgtcaccgaggagaactgccagaagagcaagatcttcttcatcgcctggtctcctgacacggcgcgcgtgaggagcaagatgatcta

SEQ ID NO: 80855 - DNA, 430 bp, Zea mays
  unsure at all n locations
  Clone ID: LIB3088-005-Q1-K1-E3
gttcggagggaagtcctcaacgacgtcgcggccatttgcagctcggacgatggcgtccaattccgcggccccggctgccgccgacgggggcgacgacctcgaccagctcctcgacagcgcgctcgacgacttcaccagcctcgacctctccgcatctgccgcccccaaaagcgccggtgaggcatcggggtcaggatcgggaggcaaggggccggtgaaggggctggggctggggcttccggaccccaaggtgccgaagcggcgcgcggggaagcagccaccgncgaggggcgcgtgcgccaaagaggcgcttgaggagctgacgcgcgagacgcgggaggctgtgcgcgagctcgagacggccactgggggtgttccgtcactggacgatgacgccatgatggaagagttcgtcaaacagttcgaggag

SEQ ID NO: 80856 - DNA, 392 bp, Zea mays
  Clone ID: LIB3088-005-Q1-K1-E4
gagaaatcttacatctttggggaaggtggttcacagaggactgcagaggaaatggacatgaaattacttggtgatgtacctcttgaaatcagtatcagaacaggttcagatgaaggcaaccctattgttgtatcatcacccaactcagcatctgcgcaagcgtacgtaaatgttgcggagaaggtgactcaaaggctcaaggagttagcagaggagcgacggatgggcccagaaatcttactttgagaaattcaggctgcttttctcacacctttccctgtttgacgctacggcgccaaaacaatgtactgataagtagattgctgttggaagtaaactttaaatttcgtcactctgtctgaaaatttactcaaacaaacttctgctgcttc

SEQ ID NO: 80857 - DNA, 447 bp, Zea mays
  Clone ID: LIB3088-005-Q1-K1-E5
gctcctaccgcagaagccctagctttacctgcccacaagcgcctacgagatgaagctcgtgaggttcttgatgaagctgaacaacgaaacggtgaccatcgagcttaagaacgggaccgtcttacacggaaccattaccgtttgacatcagcatgaatactcatctgaagactgagaagctgacactaaaagggaaaaatcctgttacccttgatcaccttagtgtgaggggaaacaacatccgctattatatccttcctgacagcctaaacctggagactttgctggttgaggaaacaccaagggtcaagccgttgaagcctacttctgggaagcccttgggacgtgagcgtggccgtggtcgtgggcgctgtcagtgtcagggacgttgagcatgctagctgcttttggaaattgcatagcgtgcatctgcagtgttacctacat

SEQ ID NO: 80858 - DNA, 424 bp, Zea mays
  Clone ID: LIB3088-005-Q1-K1-E7
caaccttttcagcagcggaggcggagcaataagtccccttggtactggtttgaatgacagtgatccatggctgcagaaagcacctttccagcaattgccacctgatacaccaagcctgttcctttcacatgaaatgccaggaaaattacacaatgacttggtttttgggtctccaaacaaatcagcccgtgagcacccctttggaccgcctggttatttgtggcccaaggaggaactggcgctgaatggagctcaggacggtggaggcgggcatatcctgtcgccgtctggtggcgcacgagttggcggcggcgttggcttattttcttcagcaagtccagatgtacagtcactgtggtcattccatgaaacattcaatgaaaaagagagcatagaatgaacaaacttttataatagaagggaa

SEQ ID NO: 80859 - DNA, 405 bp, Zea mays
  Clone ID: LIB3088-005-Q1-K1-E8
cccacgcgtccgggggtaccaaatttgctgatgtatactatacctctcctactggaaggaaacttaggtctctggttgaagtcgataggttcctccaagagaatccagagcatgttgcacagggtgtaactttagctcagttttcgttccagatacctagacctctgcggcaggactatgtcaaaaagaaaccgaagttgataaatgcaagtgatgaagcaagtacaattacctctaagtcttatgaaccagaagaagtgaaccctatagcctgggcagttcctacaaaacatgagggtgatgccagtgaagaagcttcttttgccgatgagacacttgcatcagaagtagtgctaacccggaagaggaaaataggaagctctttgtcagtagagccaaaccatc

SEQ ID NO: 80860 - DNA, 367 bp, Zea mays
  Clone ID: LIB3088-005-Q1-K1-E9
cccacgcgtccggaacaatcctgccaactttgctaagcaccaagcgaatcctaaggtgggccctatcatcgcaaagatgatggccaagttcaatgggtcccagtgatggttatgtcgcagtcaggttttgtgagcagcaagcaaaggtttgttggacagtgaacaggtgttcttttcgtgcatctggtctgggagtgtgtttagcttgtgatgaagaacatgagtgtgtgtgttggtcgtggtgcatctggaggtgcgatgagcatgtgatgaaaaaaaaaccaaacggctctatggtgatgtatgcaaaaagttgctttcgaacttgatttctcaattcacagatggtttgacagtttcttgaatt

SEQ ID NO: 80861 - DNA, 451 bp, Zea mays
  Clone ID: LIB3088-005-Q1-K1-F1
cggacgcgtgggctggaagtacgagacgcgccccacctgcgacgacgagcacgcctgcaccccctgcgagcacctgcgccaccagaagtccatcatgaagtcgcagcggaacgcgctcctcatcgccgccgcgctgctcctctactggatcctcttctccgtcacccagctcgtcgtcaggctcgagcagatgcagcagcgcgtcgacaagctcaggaagcgcgacgactgatggatccgcatccatccggtgggctcgttcttcctcttcctgccttgtgttcctgctttatgttgtggtgctcatgttttagatctcggatcgtaatttgagacctgctggtagcatctgcttcctttgccttgccgtcttcagataaaaaagaacagcgctcttggaaacgatgataatgtttaggatgtttggacgaatggtatctgtcgtaattga

SEQ ID NO: 80862 - DNA, 286 bp, Zea mays
  Clone ID: LIB3088-005-Q1-K1-F10
cccacgcgtccgacctgatggaagctttgataactgggaagtaaccaacctcatggggggggactcctgaaaccgccaggttggtggagactgaagaacgcggatctacttggcatggaaagggtatgtggtgcagtgggtctttcctgtagttacaagtcttcgttgccactatgagtggatactgtagcgaatgaaccaagacgaaatgatgctatgttaacttaacgtctgtggttgccttgaactctggaaccgtaatgctagcatggttgttggttgcgct

SEQ ID NO: 80863 - DNA, 439 bp, Zea mays
  Clone ID: LIB3088-005-Q1-K1-F11
ctagttctagatcgcgagctaactcttgttgcagttgtcattgtaacaacactttctctatacatggattaccattggacatagacagatgttggaacttggatggtgccatgcgtacatatgttggacctaatgcggtaatggaccgtcggccaaattcaatcgcctctaggtaccacaccggcgacggcgtcttcggcaaggcttgtagcagtagctcatgcaggtagtgatgacaagggactgttagcgaagaatgtcgacagcggccaatggtcatgtaaattgttcatcgtatagaagtgcaagtgacaattagccacggttttgtaattctgagctaggattagctattgggaccctgtaattcgtctgggcagacctcaaactagaggtcaacaacgtagcctggcctattgtagaatgtatcttgccctac

SEQ ID NO: 80864 - DNA, 443 bp, Zea mays
  unsure at all n locations
  Clone ID: LIB3088-005-Q1-K1-F12
cccacgcgtccgcccacgcgtccgcaggacatgatcaacgaggtcgatgctgatggcaacggcaccatcgatttcccagagtttctcaaccttatggctcgcaagatgaaggacaccgactctgaggaagagctcaaggaggccttccgtgtgtttgacaaggaccagaacggcttcatctcggccgacgagctccgccatgtcatgacaaatcttggtgagaagctaactgatgaagaggtggacgagatgatccgtgaagctgatgtcgatggtgatggccagatcaactacgaggagtttgtcaaagtcatgatggcccagtgagccacagaaccataatctgaaagcagaaaagattatgcatngcatattaatcaaaatgcaactttttattccatcgacttctagtgaaacattctgctagttgtagttgctgaaaa

SEQ ID NO: 80865 - DNA, 226 bp, Zea mays
  Clone ID: LIB3088-005-Q1-K1-D8
attctacgatttggtcctccagttctccttatgtggagactgtgattgtgacggactgtgttagtagtgttagagctcgaaggtgtcattcgatgtatatttgttcttgctctaacaaatgccctaataataataataaaaaaatcaagataatgcattagctaaaacaatactaaattaaagagacatcttttgtagacaaaatacctaagatacacgattatca

SEQ ID NO: 80866 - DNA, 401 bp, Zea mays
  Clone ID: LIB3088-005-Q1-K1-C3
atcgagtacagtcggctaggtaatctggtggtacgacgactgacgacgacatggcggccaccagcagcaagtcgtcgtcgtcctcgagctcggcgcagcgggcagcagctgccgccctgctcgtggcggtgtccgtcctggtggtgggcgcggcggcggtgtgcgacatgagcaacgagcagttcatgtcgtgccagcccgcggcggccaagacgacggacccgccggccgcgccgtcgcaggcgtgctgcgacgcgctggcgggggcggacctcaagtgcctgtgcggctacaagaactcgccgtggatgggcgtctacaacatcgaccccaagcgcgccatggagcttccggccaagtgcggtctcgccacgccggccgactgctagcagtgtgctagc

SEQ ID NO: 80867 - DNA, 230 bp, Zea mays
  Clone ID: LIB3088-005-Q1-K1-C4
ggcgccgtctcctcacgcgtccacgtacacgagcttaagcttctcgactccgaacactcatatcgacaccgatctcttatctcagggctcaagagagagcatgcacacttcctacatcataacgttcaacaagatctacacatgactatcgatcacctcatgctctccgacgctaacaaatgatctggctgggacacgaaccatcctaattatatcatatctatatacct

SEQ ID NO: 80868 - DNA, 243 bp, Zea mays
  Clone ID: LIB3088-005-Q1-K1-C5
actcccacgcgttcggctgatggtgcttacgacaaattgaagcctgcatagaatgcggcatcaggagatgccattgttctgaatactaaggctattcaggatgaaggctgttgagaagagcaagggagaaagaaagggcatcttctacaagttgtctgtattagacgcagtattactacgtagtgtcatggcacattgactgtatctgttacctatgttatcgcggatcatgtatgtagaagg

SEQ ID NO: 80869 - DNA, 446 bp, Zea mays
  Clone ID: LIB3088-005-Q1-K1-C6
agaccatcaccttggaggtggagagctctgacaccattgacaatgtgaaggccaagatccaggacaaggagggcattcccccagaccagcagcgtctgatctttgctggcaagcagctggaggatggtcgcaccctcgcggactacaacatccagaaggagagtacccttcaccttgttctccgcctcaggggtggtatgcagatctttgtgaagaccctgactggaaaaaccataaccctggaggttgagagctcggacaccatcgacaatgtgaaggcgaagatccaggacaaggagggcatccccccggaccagcagcgtctgatcttcgccggcaaacagctggaggatggccgcaccttagcagactacaacatccaaaaggagagcacccttcaccttgtgctccgtctccgtggtggtcagtaagtcatgggtcgttta

SEQ ID NO: 80870 - DNA, 440 bp, Zea mays
  unsure at all n locations
  Clone ID: LIB3088-005-Q1-K1-C7
ctcttccatacgaccataccctacctccaaattcccaattgtcaacctctcctcagagttggagtgaccatgtcggggcgcggaaagggcgggaaggggctgggcaagggcggcgcgaagcgtcaccgcaaggtcctccgcgacaacatccagggcattacgaagccggcgatccggaggctggcgagaaggggcggcgtgaagcgcatctcggggctcatctacgaggagacccgcggcgtgctcaagatcttcctcgagaatgtcattcgcgacgctgtcacctacacggagcacgcccgccgtaagaccgtcaccgncatggacgtcgtctacgcgctcaagcggcagggccgcaccctctacggatttggcggctgangggtcaggggtgtccgccagctgctgctggtcgtggcagaagtcttgggtcgcggtca

SEQ ID NO: 80871 - DNA, 337 bp, Zea mays
  Clone ID: LIB3088-005-Q1-K1-C8
cccacgcgtccgcccacgcgtccgcccacgcgtccgtctgtcgacactctcattgaggacgatctgtgcgctgagccagttaacgagtacgtccagagctgcgacatcgttgccttcaacaagatctaggcgtgactttcgatcagtccttcccctggggtgctggcgatggtggtggctgggcaatgcaccagcctaatttttccatagctatatgtctgctttgtgtggccagtgatattgccgtgagtatttttggatcctattcgagtcgaatgtaccagtaccagagttaatttgctttaattcgaaacaccgttccggttggaattctgtt

SEQ ID NO: 80872 - DNA, 369 bp, Zea mays
  Clone ID: LIB3088-005-Q1-K1-C9
catcaacaaaggaattggtgttgacaatatgcactatctaaatgatggcctatggaagatggaacggctcgaatgagtagaattctctgaggggttcataacttgcggcagatcgtattgatggacatatgaaaccagcaggaccctatttgcacagctggtatcgttttaaaagatgaagtactaagaagctttatttacctgaggcaacttgagcttactccgaccctttggtgtggagtgcatgtcagaaacaggattatgaatgctgtgttcagtgcttttcacaaattgttgtattttcaccagaacaatttccctcaattggaagtgaagaaatccataacgatctataagttatttgatctt

SEQ ID NO: 80873 - DNA, 406 bp, Zea mays
  unsure at all n locations
  Clone ID: LIB3088-005-Q1-K1-D1
gcgcccacgcgttcggttctgctccggtggctcaagaagcaagcgtcgcacccgccccgatttggattccgaggacgaatacaacattcccgccggactagcgatcaccgtacctnctgtgcctcgaggtggagcccgccgtctgcgactcgcgcagaccacatctaacgcgtgtggcgctcgtccggctcacgggcaaacacccctttaacttagaaccttcggtgtcgtggctgatggcgcacgacttcatcaccccggcaccgcaccactaccactactggaaaaatatcggctagaaaccgaagttcttactctaatagatcaacgttcttatgtaaagcttgtttcgataggtcttatctaatacctgtaatgtacaatgggcagtttgatgttcataatg

SEQ ID NO: 80874 - DNA, 440 bp, Zea mays
  Clone ID: LIB3088-005-Q1-K1-D10
ccaacgcgtccgaaaaaacggaaccaaccccacaatttctccgccggttgaagaattgaaggaaacggtccggccgtcgaacatcctaatcaagcacgagggttcccgccgcaaggcctcctggaaggaccctgacggccgcatcatctccgccaccacgcgcggcgacgccgcagcgcgcctcctggacctccgcaaccagattctctccggccaggccaacttcgccgacctcgccgctcggcactccgactgctcgtccgcgcgacgcggtggggacttaggtacctttgggaggaagcagatgcagaaacccttcgaggacgccacatatgccctcaaagttggtgagctcagcgacatcgtggacactgacagtggggttcacatcatcctgcggactgcctgaggaggggatcacactgtcctctcaggctttc

SEQ ID NO: 80875 - DNA, 307 bp, Zea mays
  Clone ID: LIB3088-005-Q1-K1-D11
ggaaatattctgtagctggactcacaagactgaccttttccaaaggatcaagaggaaaactggaattccctacaaatgcatgctgttctttgatgacgagaacaggaatattgaagcagtatcaaaaatgggagtgacgagtgttttagtagagaacggtgtgaaccttgacatgtttaagctgggtctcagtaactttgcaactaactgtgctgcctacagcagaaaggatgatgaataacctcgaggagaagtgatacatataagataataccttcaaaacactgtactcgaattcattgtcatc

SEQ ID NO: 80876 - DNA, 438 bp, Zea mays
  Clone ID: LIB3088-005-Q1-K1-D12
cccacgcgtccgcccacgcgtacggggatcctcagctgggtataatcggttcgaatagtcggtgctcctcggtcatggagactcaactcactgaccactcatcgtagtttataagtgaaataagaatttggggaaaagaaagctagaccaggactagtgaatgctttagatcaagcaaatctagattcaggaaaagtacttaacttgtgaagtaaaattttggcataaggattcactactagtaagctcttccgcaaaatgagtctttgaaatttgataagccttaccttgattcccgacaagtcagcatacccttgagagtcttttctttagtcgggtaagtcttgctgagtaattccatactcagggctctattccctggtgtacattaggttatagtactgctctgttgtggatggtgctaagtgccggtgggct

SEQ ID NO: 80877 - DNA, 209 bp, Zea mays
  Clone ID: LIB3088-005-Q1-K1-D2
cccacgcgtccgaatttatgtaggagaatttttccaacattcgttttgggcggagacattgatctcaaaacactcgtaactgtcctactaggtggtggcatgggtccccaaaacatggtcatagggtgtgtctagtctgcccttcgttgcagccgggcaattttccttacatatatgctttgcttgattgtgatagcatttttattatg

SEQ ID NO: 80878 - DNA, 316 bp, Zea mays
  Clone ID: LIB3088-005-Q1-K1-D3
cccacgcgtccgtctacacatccgcggacctttacacgaactcgtcatacaaacacgcagggaagcgttatgagtgggtcgggcatctttaagctgttgcaagcattggtgccaacagtatcccagatgacgaacaacgtgaatgcgagaataaagctgttatactaactggggccatcgatcttgcagagacagattttgtagacaaagaataatgtgctatggttatcgtttagttcttgatcatgtttcttttacccacttgccgttaaaaaaagatgtcattaatggctggtgaaaagcaaatttactgttc

SEQ ID NO: 80879 - DNA, 365 bp, Zea mays
  unsure at all n locations
  Clone ID: LIB3088-005-Q1-K1-D4
cccacgcgtccgctcttcttcacctcactaacaccagctagcaactctttctctcctgcaggaatggccgctcgctcctcctgctcccagccgcagctggtcgcggcggcggcggtcctggcagcggcgctgctgctgctggcggcgggggccgggacggcgtcggcggcggtgagctgcggcgaggtgacgtcgtcggtggcgccgtgcctcgggtacgcgatgggcagcgcggcgtcgccctccgcggcgtgctgcagcggggtgcgctcgctcaacagccgcgcgtcgtcngcggcggaccggcaggccacctgcaactgcctcaagagcatgacgggccggctcggcggcggcgtcagcat

SEQ ID NO: 80880 - DNA, 359 bp, Zea mays
  Clone ID: LIB3088-005-Q1-K1-D5
gcagcatgcttgccgaggatgcgattaaagctgctgtaaaagactacgaagccgagaagtggaagatggggcagaagggtgaagacagcccttcacagaaggctgctgaagcatgaaaggttctgccgtgaagtatattgtgctgatacgtttctcagtccatgactccccgtcgcatattgccaaagataaatgcttctgtttgtgaggcgagggattgtgtgtaatgttcacgaactgtggtagtgcggcatgtgactcaactgttttaaagatggtgatgaccaatttcaaataaatttgctgccatcgtagaattagaagtactatgtggatttacaggaaaaaattatctaata

SEQ ID NO: 80881 - DNA, 408 bp, Zea mays
  Clone ID: LIB3088-005-Q1-K1-D6
gtcacgcgttcgttcaaagagcggtctgcatctgacgggtcctgcactaccaacgctatggtctctcacaactctgacttcaaggaacttctgaatggcgacaaggagggccttattaagctcccaagtgacaaagccctgctgagccaccctgtcttccgccctcttgtgcagaaatatgctgacgatgacaaggcattctttgatgactaccacgaggcgcacctcaggctctccctactggggtatcctgatgcttaaacgctccatatacaggagcgcgacacaaactgctgcctgtatggacacttgcgattcatgatgaaccatcagattgcctattgtcgcctttgtaataaaggcatatgctcttagaacttcgactatggctgaatctgaacccatttt

SEQ ID NO: 80882 - DNA, 350 bp, Zea mays
  Clone ID: LIB3088-005-Q1-K1-D7
cgtattctcaacagcgccgagccacaacacgatgtactcatacaaagacgcagatgggcgtcgggagtgggtcgctcatcttcaggctggtgcaggcattgttgccgacagtagcccagatgacgaacaacgtgaatgcgagaataaggctgctgcactagctcgggccatcgatcttgcagagtcagcttttgtagacaaagaatagtgtgctatggttatcgtttagttcttgttcatgtttcttttacccactttccgttaaaaaaagatgtcattagtgggtggagaaaagcattaagactgttctctagagaaccgaagaaatatggaaattgaggttatggctt

SEQ ID NO: 80883 - DNA, 442 bp, Zea mays
  Clone ID: LIB3088-005-Q1-K1-C12
cccacgcgtccgaatgctacttgatcagctctttgacctcaaaagcaaggaacaagaatggctggatctcaataaagacctaaggaagcagctgcaagaaacaaggccagagaacgcgctccgtgtctcctgggaggaaggtgggcacagtggcgcaagtgggaatgttcttgatccttatcaggggctccttcagcacctggacaacgatccttccctgcagttcgggtaccatcatcaagcctacatggatcagctgaacaacgaggacctggtggacccgaatgagcatggtcgatctggatggatatgaaatgctctgatgacccaaaataaagttgatgcacagcagggattcaccctgcaggacgcgagactatgtattgaagctaagacctcgtgtgtgttgtgttgtgtgcgaagcttggaactttataaatcg

SEQ ID NO: 80884 - DNA, 454 bp, Zea mays
  unsure at all n locations
  Clone ID: LIB3088-014-Q1-K1-A12
tggcaagatagttgtcgtatttgcggggtactgtgagccaatgaagcgagtcatcgccgcgaatgatggcttctgcaggcgggtcacgaaattcttctatttcgatgatttcagtacgacagaactagcagagatcctacatatgaagatgaagatcccaagtgactgtagcttgctttacgggtttaagctgcacccaagctgcagcattgaagccattggagagctgattgccagggagatcactgaagagcagaggaagcagatgaatggaggccttgtagacacgctgctcatcaatgcccgcgagaacctggattcgcggcttgatttcagctgcaacgatgccgatactatgatcacgatcacgttggaagacctggaggcaaggcttcgtcagatttccagacaacgtcacctgcagtgacatgntaaattaggagaaatttttctc

SEQ ID NO: 80885 - DNA, 388 bp, Zea mays
  Clone ID: LIB3088-014-Q1-K1-A2
gtcccattcctgatgctcggtcttgacctgccacctccacctcttttcaaagacgccatggagagaaatatcattccacaggtaccattgtttaacatactgaagaagttcgatggtgagacagttacagaggttgtccgaccttccattgcccgaatgaggtaccgagtcactagactgccgaagtatctgatccttcatatgcgaaggtttaccaaaaataacttttttgtcgagaaaaaccctactctagttaattttcctgtgaagaacttggagttgaaagactacattccattacctaagccgaaagagaatcataagctacgttcaaagtatgacctcatagcaaacattgtccatgatggcaaacctggcgagggatgct

SEQ ID NO: 80886 - DNA, 178 bp, Zea mays
  Clone ID: LIB3088-014-Q1-K1-A3
cggacgcgtgggcggacgcgtgggcggacgcgtgggttttctctctctctctctctctgttatgagactactggtactctgtcgatgtcgattggattagactagggctggtgtgtattctgtggatgctccgtgtttctggtgggattcaagttcaaccctgggattattgtatttc

SEQ ID NO: 80887 - DNA, 449 bp, Zea mays
  Clone ID: LIB3088-014-Q1-K1-A4
accaccgcagcggctgcgacctgcgagtgcgacaacctccgcggaggagttggagccggcggcggggatatttgcttgcccggctggggttgcggcggaaggagggagagacaaccggcgatggcggcgtccgcgaggcccggggatagggcgaccagcttcgccgtcgcgtgcagcctcctcagccgcttcgtccgccagaacggcgtcgcggctgccgagctaggcctcaggatcaaaggcgaggtcgagcagcagaggacgccggcgacaactaacttgctccccggagcggagggcgaggaagtcgaaaggaggaaggagaccatggagctgttcccgcagagcgtcgggttcagcatcaaggatgcttgccgccctagggaggagcaaggagataaagagaagcctaagcagctcacaatcttctatggcggggaggtgctggt

SEQ ID NO: 80888 - DNA, 404 bp, Zea mays
  unsure at all n locations
  Clone ID: LIB3088-014-Q1-K1-A6
ctactgtttatgttggcaatcttcctcacgaggctaccatgaatgatgtgcacctgttgttccattcactgggggctggttcaattgaggaagtccgtgtaactcgtgataaaggctttggctttgtgaggtacagcacccatgaggaggctgcattggcaattcagatgggtaatggccaacttattggcgggaggcagataaagtgttcctggggaagcaagccgactccacaagggacagcatccttgcctctgccttccccagcactggcaccattctccactggagtgtcggccaccgacttgctggcctaccagcgcctgactctgagcaagatggcctcgaacccagccctaatgggtcagcacgccttgaaacangtcgctgcattggggattggc

SEQ ID NO: 80889 - DNA, 282 bp, Zea mays
  Clone ID: LIB3088-014-Q1-K1-A7
cccacgcgtacgctcgaatgccatagcccatagttagccatggcttggaataacgtaggggctgaccgatatgccagtaggcaccttatctagtacttacagatctacaaaaagtttgtactatacatatatggacaaccttataagtggctatgagtgtacctatcctaacgcttatcccaaatggtgtatcagcgtcatattgtgagattgtgttcaagcaaacataattcaaatatcaaagtattcttgaatgtgccttacccaaaactgacaccatca

SEQ ID NO: 80890 - DNA, 299 bp, Zea mays
  Clone ID: LIB3088-014-Q1-K1-A8
cccacgcgtccgggaggacggcgacgagatcgacgccatgcttcaccagaccggaggcggcgttcctagcacgacctaaaagcagcagctgcggagcctcgttttgctctccgccctgcgtagtactaaacaaaagggaaaaagtctttttaaggaacttgtgatgctctggctccttgagccattgctgagggacatccttagcctttatttagtggcatggtctggtactcagttctgacatcactcgtttatctatccctaatacatgccgccatgtttgtacttccaaaacaaaa

SEQ ID NO: 80891 - DNA, 421 bp, Zea mays
  Clone ID: LIB3088-014-Q1-K1-A9
gaatgggcaaagaattgtgatgttctcttacggcagtggtttgacatccactatgttttgattgaggctaaacaatggccagcatcccttcagcctatcaaacattgcttcagttcttgatgtcaccgagaagcttcagtcaagacatgagactttgcctgagaaattcgttgagacactgaagctgatggaacaccgatacggcgcaaaggacttcgagacgagcagagacacgagcctactgcagccgggcgcattctacctcaccaaggtcgactccatgtaccggaggttctattcccagaagctgtccgaggaaacaggcggcgggaaaaccaagtgctgcaacggcctcgcaaatggccactagtggtcgcccagcactgttgctcatcattctcagtattttgataatgctcat

SEQ ID NO: 80892 - DNA, 385 bp, Zea mays
  Clone ID: LIB3088-014-Q1-K1-B1
agggacacagagttgcaatggttggtgatggaataaacgatgccccgtctttagcaggcgcagatgttggaatagccatgcgaactcattcaaaagagaacgctgcctctgatgcagcttcagttgttctactaggcaacagactttctcaggtggtagatgcgctatccctgtcgaaggcaacgatggcaaaagttcaccaaaatttggcctgggcagtggcatataacatagtagccattccaattgccgctggagtgctgctgtcacaatatgatttcgccatgacaccatctctctcatgggggttgatggcccttagctcaatctttggtgtcagcaattctttgcttctgcagctgcatgggtcgcttcagaacacaag

SEQ ID NO: 80893 - DNA, 245 bp, Zea mays
  Clone ID: LIB3088-014-Q1-K1-B11
cccacgcgtccggaaaatcatcaaccgatgtggaaaccaagccgtcgaagctcgttgagcgtgtccactctacatgtcctcctgccgtctcagcctcttgtgttttacaccctacaactcctagtaccgccgaataagatttgctatctgcaatgtgctcatgccaccgctgtgtgtgccagttaacagtttgcacgaaaccctagatattttgttatacgaatgaatgacatgtggtgtttgat

SEQ ID NO: 80894 - DNA, 456 bp, Zea mays
  Clone ID: LIB3088-014-Q1-K1-B12
cccacgcgtccgaatcactacaaaatggatctgaccccaaagaaagaagccatcaaaggggtgatccaagacgagttaaccaagttatcagaggaggatgaaggagagggagacgaagacaccgggaagaaacagcagcagcctcaggcgcaggagatcgaggcatgaggatccgcggaaccccgtagctgtagtagccgctgttaattatcctgtacttagtgcgtatgtgtcgcatgtacaggcatcctttgttgatttcagccaccaacttgagaacctcaccccctgattgtgtatgctaaaagacatgatgtgtaggcagcctccacaccttttagctgactgatcggagagttactcttaggcaacaacttgtgtttctagatttgcaaatggtgtctgaaagactgaaactctgcattcgctgtggcagggcgtgtacttaaatgttcg

SEQ ID NO: 80895 - DNA, 321 bp, Zea mays
  Clone ID: LIB3088-014-Q1-K1-B2
aaggcacgtacaattgcaaggaccagtgttggaacatacgatgccccatctttaacaagcggagaggtttgaataggcatgcgaacttattcaaaatataacgctgcatttaatccaacttcatttgctatactctgtaacagactctctcacgtcctacatgcgcgatccctatcgaacgcaaccacgggaaaagtttaacaacatttggcactgtaagtgccatataacatagtctccatttcaattgccgcttcagtgctgctgtcacaatattatttcggcatgacatcatttatgtcaggcgggctgatggccctt

SEQ ID NO: 80896 - DNA, 379 bp, Zea mays
  Clone ID: LIB3088-014-Q1-K1-B3
acgagcaattcgacttttctggggccgcagccctacaagtaaacagtctaggggtgattatggccacgggcgcaacggcaatggcatgtactacgggacgccattctacggtggatatgggtacgcctcaccggtcgcccacccaaacatgtatgccgcggcctacggagcctacccgtactatggaaaccagcagctagtgagctgatgtggcaatgctctctgttcagtttcctacctcggatcggagggaggaaaccaagtctttggtcctgtaagatagtagctacaatgagatattataggcggccatacaaatggtctagagacactagaagggtttttgattattatgctactctgtacacttgtgctgttt

SEQ ID NO: 80897 - DNA, 449 bp, Zea mays
  unsure at all n locations
  Clone ID: LIB3088-014-Q1-K1-B4
gcgaggagcaacttatgaagagttttgaggagaaaaaagatgccatgctcagctcgctggggaaaatcaatgtggttgatatcgagtccacgctctcacgtgtctgccaagcagttctgagagatagcatggtctccaaagatgtcctgaagctgcgagccaaagcgttgaaaaagctcggaacgatattccaaggcgcagagtctatgtaccgtcgtgaaaacagcctgcgcgttgaaacgagcacagaccaacaagccgcttcgtcacactgaagccacctgtggaccaccgtgtaggaatggatttggtgttttgtgtgtgtgtgtggctttcttctttgtttgtaattgtgtatgctatattaattntcttgtagaagatgtgaaacatttaacacaaagattttaactgctattgatgcagaaattaacctgcagcttgctttt

SEQ ID NO: 80898 - DNA, 389 bp, Zea mays
  Clone ID: LIB3088-014-Q1-K1-B5
cccacgcgtccgtccagtgattcaaagggattggtttatctgtttgaggaggctctcaagacaccggatcccaaggaaggccttcaaagactgattgatccggcgctcggcgaggattaccccatcgactcgatccttaagatgaccgtcctggcaagggcctgcacgcacgaagaccccaaagcaagggccacgatgagatacatatagggggcgctctaaacactcgtgttaaaacgagcgatttctgacacatgaacgctacccaagaaaaccaaggtgtcgagaaccttatgttcgggagatgacttctgtccctgtgggctgtggtatatattattgtacgtgctacctgacttcccctgggcaattgtacattaaggcataat

SEQ ID NO: 80899 - DNA, 159 bp, Zea mays
  Clone ID: LIB3088-014-Q1-K1-B6
cggacgcgtgcgcggactcgtgggcagacacgtgggtgaggctacaatcattcgactggaactggaatggccgaggttttgctggccacagctcaagtcacaaaaaaaaaaaaaaataaaaaaaaaaactaaaaaaaaaaaaaaaaaactactagcaaa

SEQ ID NO: 80900 - DNA, 453 bp, Zea mays
  Clone ID: LIB3088-014-Q1-K1-A10
gcgcgccgcccggttccgcgccggccgcgccgtgctgcccaagtggctcatggaggacgtggcggcggaagggttccaggcggtgcgcgcggcggggagcagggccgtctgcgtcactgccatgcccagggtcatggtggacggcttcctccgggagtacctcggcgtgcacgccgtggttgccagggagatgaaggtggtctgggggttctacaccgggatcatggaggacgcgcggccggccgagggtgcagagatggtgaagaaggcggcggaagaacagacggtcgtcgtcgggtactctgcgtcaatggagtttcttaaccatcctctctcacgttgctgcaaggagctcatctcccccatcggccgcaccgtgccgcctgacgcggaccgggacagcgacggcgccgtcatggcgcgccttctggaccgggcaacctcgtcgtcgtc

SEQ ID NO: 80901 - DNA, 218 bp, Zea mays
  Clone ID: LIB3088-013-Q1-K1-F6
acgcggacgcgtgggaaaaaaaaaaaaaaaaaataaaaaaaaaaaaaaaaaaaaaaaaaaaaaagaaaaaaaaaaaaaaaaaaaaaagaaaaaaaaaaaaaaaaaaaaaaacaaaataaaaagaataaaaagaaaaaataaattattaaaaacaaaggaatacagacattacccttgttgaataagaagaaaaaccaaaataaaggatttaaataagc

SEQ ID NO: 80902 - DNA, 456 bp, Zea mays
  Clone ID: LIB3088-013-Q1-K1-F7
acgggaagggtgttgccatcaactttgtgacccgcgacgacgaacgtatgctgtttgacattcggaagttctacaacgtgttgattgaggagctgcctgccaatgttgctgaccttctgtgatcaatttcaagaaaaaacaaaacaaaaaagggtggtgaggaacctggtaaggcttggttttgtcgaaataccgtgggagagggggtgataaggacggtggggtttctatgttgaagtcgtggtcatggacaatttgtgattttttctcctttatgccatgttttggaatttttgtagctgcctaggccttgtggtaatgtgctgctgtgggggttcattagtatgaagaggaagacgctgctggcgctgagtctttctctttattagtattttgtttaaaactatgtatgaccgaatggtggtatttatttgtgtcatccttgactcttattct

SEQ ID NO: 80903 - DNA, 279 bp, Zea mays
  Clone ID: LIB3088-013-Q1-K1-F8
acgaaaaaaaaaaaaaaaaaaaaaaaaaaaaaattaaaaaaaaaaaaaaaaaaaaagaaaaaaaaaaaaaattaaaaaaaaaagaaagaaaaaaaaaaaaaaaaaaaaaaaaaaaaaaaaaaaataaaaaaaaaaaaaaaaaaaaaaaaaaaaaaaaagggggactttattaaagtttaaaaattaaattaattttttataaaaactaaaaatttttaaaatgggtccctaaaaaaaaatatatcgccctagttttaaaaaatttttcaatttaaaaac

SEQ ID NO: 80904 - DNA, 461 bp, Zea mays
  Clone ID: LIB3088-013-Q1-K1-G1
gaggcaatctatactggaaaaagttcaggcaaagcaatttgaggcactggcctcagttgaggacaagatactcagaaaaatacgggacaaagaggcggaagtggagaccataaacaaaaggaactctgaactagaggaccagattaagcatttgggagtggaagttggtgcttggcagcatagggctaagtacaatgaaagcatgatcaatgcactcaagtacaacttggaacaggtttgtgctcaccagagcaaggatttcaaggaaagctgcggcgatagcgaggtagatgacacggcgtcctgtcgcaatggtggtgctatcaattttcaactgactccgaaggagaacagacaaccgaaggatttgacggcttgcatggtctgcaaatcaagtgaggcatccatgctcttgctgccttgtcggcatctttgtctatgcaaggagtgcgagagcaagc

SEQ ID NO: 80905 - DNA, 462 bp, Zea mays
  Clone ID: LIB3088-013-Q1-K1-G2
acgcggacgcgtgggcttgaccaccaggaatttcattcgcacagtcaccgatatccgtggggactggctaggggatattgcgccacatgactatgatctgagcaatttcccgtcatgtgaggccaagcgtgttcttgagaggctgtataacaagcgagagagggaaagagctgcaaatagaggctgaggttgatacttccacaaacctggtgctctgtaattccaccgcaggtctatccagagcccgtatacgagctttggttatcacagatagctgtcccatttgtcttaggcaaatgcgttagcatgatgtctcctacacaccctaatatctattgtctcatcagcatgatcattatgtacacaacctcgagaaattctttagcatctcaattagttgtgattcagattaattgtgtgacagtctggttttgtatgcatcagacgtttatgttttgtgtt

SEQ ID NO: 80906 - DNA, 245 bp, Zea mays
  Clone ID: LIB3088-013-Q1-K1-G3
gccgccgccgtccgcccgtcgtcgctgcgcttcggtacccgcgaagcaaggccccgcctcgggtgtacgggccgtcgaagaagggagaggagcagatgaaggcggggaggaagaacctgcggcgggcgtgcgacgagggcgccgtcgtcacgctcgccgagggagagagcatcatgcaagtcctcacgctgcgcggctacaacgtcatcgaggtgatggacggcgtgggcgttaggttcctggcc

SEQ ID NO: 80907 - DNA, 305 bp, Zea mays
  Clone ID: LIB3088-013-Q1-K1-G5
actacaaccattcattttatcgtccacacctttcctgctgagggatgcttgggggatttgattttaacatcgggccaatatcaattaagcatggcattttatttggaaatagaagtttgtggtggtgccatggacctgtgcgtcccttgtgaaatgaattgattttctgtcattgaattttctaactgaagctttttcattcgtttgattcacttgagctcccttaagttgtattgtattatttaatcataaatgtcatccttcctcttatagttatataatcaaatattagttttaatccaaaa

SEQ ID NO: 80908 - DNA, 243 bp, Zea mays
  Clone ID: LIB3088-013-Q1-K1-G6
aattcaagatacccagctcagctccgagcgcctgattgattgcgaacaaaaaacagatatggaacaggacagtgcagccttgctcgtaacccaagaaacggtgctccaccgcccattttcatgtttgtgtaacagttattattcatcggtaacactaggactttgggtggacgcggcagtaagcatgtatttacacaaatactaacacactggtcctgtattgattggtactagttttggacc

SEQ ID NO: 80909 - DNA, 155 bp, Zea mays
  Clone ID: LIB3088-013-Q1-K1-G7
acgcggacgcttgggtgactggacatactggatacttgataaaggaggagttggtgataatggggacatcagtggtgaatcgatgcgtgatgaggagcatgctcatattgatacattgagaggacgtatacttgatacaatcctcaggcttagat

SEQ ID NO: 80910 - DNA, 127 bp, Zea mays
  Clone ID: LIB3088-013-Q1-K1-H1
ggtaaaactcctatactgagccctgttgaactggaagaaataggttataaaatcatagcctgtccattatctctaattggtgtatcgatgcgtgcaatggaagatgctcttattgctataaagggtg

SEQ ID NO: 80911 - DNA, 433 bp, Zea mays
  unsure at all n locations
  Clone ID: LIB3088-013-Q1-K1-H2
acgcccacgcgtccgcccacgcgtccggccaaggagttggccggcaccgtcaaggagatcctgggcacctgcgtcagcgtcgggtgcaccgtcgacggcaaggaccccaaggacctgcagcaggagattgatgacggagaggtcgagatcccgtccgcttgaagactagccatccaaggggacttccattggtgctgctgaagtgttgttgttctgcatgctatcgatgtacctttttcaagcaacgcgagccatctattttttttgtctagctatgttagtgatatcttgtgagagacctcaatgttaccaccgtatctttgtctttgttggatggagagatttaagcacctcaccacacctttgttctttgttggatggagagttttaagcatcagctgtttgaagttgaaaaaaaaaaanattacatgaa

SEQ ID NO: 80912 - DNA, 389 bp, Zea mays
  Clone ID: LIB3088-013-Q1-K1-H3
acgatctggagcagtggtatccggagtgtgccgaggcgtgtccgtgtcaggatcgcacgcaagaggaacgatgaggaagacgccaaggaagagctttactctcttgttaccgttgctgagatccccccagaaggcctgaagggtctgggtaccaaggttgtggaggacgacgagtagatctgcctgggtactgatctgtgtcaactgtcaaatcatttttttggtgtttttgagtttgttagcactaagttgatagccttgtgagaaaaattgagttttctgatggcgcgcttgttctcggctggttttaaacttttgaagatacctgcaccaagtattgtagtctgtcgttccaaatcttttctggaggcatcagccatgcaacataa

SEQ ID NO: 80913 - DNA, 474 bp, Zea mays
  unsure at all n locations
  Clone ID: LIB3088-013-Q1-K1-H4
acgggcaaattttcatgagtaccattctcactgttataagattttcatgaggcaggaagcaaagccttgagctagcttgtttgcatatggaaaggttcatactcctgactccaacagatattggattgctaattcatacgaatatagattcatatctggccttgaacctgaaaatgttgataaggagtttttaaggctttggttcaagaacaactgcaatccatatgaagacacagttctgccagaagctctagaagagttggtatgttagttggcctagcgatatgtatctctgtaaatttctgccgatgtttctcacttcaaagttgatactcatgaggccttatcgtctgaaagaagaaatggtcatccaaagatcatccaccgtgacattaaagcatctaacattcttcttgacttcaaatttgaagctaatgtcgctgactatggacttgcaaagntcactactgataa

SEQ ID NO: 80914 - DNA, 341 bp, Zea mays
  Clone ID: LIB3088-013-Q1-K1-H5
aactcctatactgagccctgttgactgcagaaatggctataattttaaccggtacatatcttaattgggtatcatgcttgcaatggagatctcttattgctataaggctggcgcataccttcttcaacaccttgcaacatttgatgagatcaagaaactcttggcttaaccactattacgaagaagacaaactatatgctgtgacaccagcccaaccattgtacgggactggctatgataattatacaagtgaaccgaacaatcccggagaatccaagtccagggctaaaaaaacacaagaaccctgtattgacatattgccttagctctatgatattggt

SEQ ID NO: 80915 - DNA, 435 bp, Zea mays
  Clone ID: LIB3088-013-Q1-K1-H6
acgaattcactgtggacatgaaagactaccttactatggctctgctagatacctgcgagcattgcgtgatgctggaaaagtgggttagaatcagagaatggctgctgctccaataaaagatgaacggagagaaaagatgatgaaaaagggctctgtcaatacgccgctgcaactgcaacccatgccatgccagcttagagattgggtataatttgcctagacagcagccagcattattatgtgctcatcttttatctttacaaaaccggtcgttcgatatcttaatttctttctcacaaaaaccccttttttcgactctgtactgaaactgctgggacattcccaatatcgttgcataacattcgcatgctactgttactcaagggcacaccccttgaagcggccatttaaccccgctagttttggggtttcccc

SEQ ID NO: 80916 - DNA, 339 bp, Zea mays
  Clone ID: LIB3088-013-Q1-K1-H8
acggaagtggtgtgtttccgagcttggcgagaggtacctttcatctgtcctctatcaggcataagagaagaatgcgagaacatgcagcctgagccatgagggagccgtcactttaagcgggcacagtaaatgtttctgaaataagacgcgtagctagcatcagtttgctccacttggtatcatttggccatgctcactctatcctttcgctagcctctatgaccggacctaaactggtgtgtgagaaacatccacgactctcctcccaactgttttcctaaagcgaaatgataacacttcttaataattgtctatacgattgaagctgatttgattggt

SEQ ID NO: 80917 - DNA, 105 bp, Zea mays
  Clone ID: LIB3088-014-Q1-K1-A1
taaaaaaaaaaaaaaataaaaaaaaaacaaattaaaataaaaaaaaaaaaaaaaaaaaaaaaggaaaggtaaaattaaaaaaaaaaaataataattacaaattaa

SEQ ID NO: 80918 - DNA, 462 bp, Zea mays
  Clone ID: LIB3088-013-Q1-K1-F5
acgcccacgcgtccgatttaactgcatgaagcgtgaagtatggagtttcacagtggaaaccacgcccatctggtaacccttctggctatggaaattacactcatccagctggttttacaatgggttctcctggtgttattggagccacagttggtgttgatgatgtcaataggatgaagtacaaggacaacatttatgcctcaactccacaggtcgagacatctgacatctggattcagcaagctagagagatgccacctatgcaggttccttcatattacaacataccaggtcaagcaacaccaggtgcttttgtgccaaatccagcaaatgcatctttcaatgctacagctcaatcctctcatgtgcagttcccaggcttgtaccatcctcagcaacctccctctattgtaagtccgcaccccatggtgcatcaacaggtgccatcggccattggtccca

SEQ ID NO: 80919 - DNA, 319 bp, Zea mays
  Clone ID: LIB3088-013-Q1-K1-D4
aacgacgtcgagttagtctctcgctccgccttcctcatcaaccagaaatgccatgtcaaggggaaggatgtcaggaagtttttggatggtatctatgtgagcgacaagggtgtgatcgaagaggagcagtgagggacaattagttgttatcgtttgagttggaattattgtttggtttgcaattttctcaaggtgaactttgtaatcggttaggatgtgttgtggaccattatcttatcctacaatattatcgtatctgtttaagaaaaaaaaaaatattttattattattatatataaatttatttatttagtgtaat

SEQ ID NO: 80920 - DNA, 294 bp, Zea mays
  unsure at all n locations
  Clone ID: LIB3088-013-Q1-K1-D5
acgctgccgccctgtgatgtgatgtgactcgctgtaaatatcctgctgccttctcgttgggacgtgcaactanggactaggtggctgttttcctcggtattgaacggttttttcctttttttggctgggaaaatcgacctgtacctaaccgattggtttaatgtgcaaaaaaaaaaaaaaaaaaatataaaaaaaaaaatataaaaaaaaaatattaataaaattaaaaaaaagggggccattttaaaggattcaagcttccaatcccagtgttttaaacttaataattttttt

SEQ ID NO: 80921 - DNA, 267 bp, Zea mays
  Clone ID: LIB3088-013-Q1-K1-D6
acggaaatttgttagaacgataggcctaagacttcgatggcctatcgccctatcggatactcagtaaaaaaaaaaaaaaaaggaagaaaaaaaaaaaaaacaaaaaaaaaaaaaaaaaaaaaaaaagaaaaaaaaacaagaaacaaaacaaatggaaaaaaaaaacaaaaaaaaaaataaaaacaaaaacaaaaaaacaaaaaaaaaataaaacaaacagctaaaatctaaaaaatatgaaaataaaaaaacaatatagaaaatgaa

SEQ ID NO: 80922 - DNA, 400 bp, Zea mays
  Clone ID: LIB3088-013-Q1-K1-D7
ctattgaggcccgtcgctatgatgctggtgtataaggatctattatcagtcgacaagctagtgacaaagtgattgacctactacgagctcacgaacgtcgtcttgctctaggtctagagactgtcggtcaaccgatgacctgtcgaagtcgacattgcagcaaattcatcaccaaaaggtagcaaggactatagagctactgacacaactatcatggtgtgtgaaatcatggacacattgctgatacgacagcaacctgctacagccacgagatcatgaaggtctaacattaacggcatacatacacgaatctcactgctgtgtcgaaatcacagaatgctgatgaattcacaccggctgtatactgaacatccatgcctatgactagcacgctgaacga

SEQ ID NO: 80923 - DNA, 254 bp, Zea mays
  Clone ID: LIB3088-013-Q1-K1-D8
cttgatatttggagtttcgctgccagtcattatagaagattgtaattttctatgacttatgttaaaaatgagtagttacatgtgtttttttagataatagataaaaaaacaggctttcacgtattttatggtcggaccttatggagtgtttgaaaaaaaaaaaaaaaaaaaaaaaaaaaaaaaaaaaaaaaaaaaaaaaaaaaaaacaaaaaaaaaaaaaaataaaaaataataacaaataatataaagaaaaa

SEQ ID NO: 80924 - DNA, 459 bp, Zea mays
  unsure at all n locations
  Clone ID: LIB3088-013-Q1-K1-E1
accacgcgtccgtccacgcgtncgtgaagcatcagcctctaacagtgaagcaaataagtagggtatttgccaaataaaggaggcacatgaagtcaagcgtgcagccataaatgacatggcaactatggagaagcaaggaggtttttggaccaagcctctgatggtagagaaaggggcagcatattggaagttagatggttactgtgataactcagcaatattgcttcaagagtatggtggcgatgaattaatggcaaataaagacaagtggtttatgtttactgaagacgaggagaaaataattgaaaaacatttagccactaggtaatgagtttgtcttgccacgtttggatgtgtttctacctttccaatgatggtgaacttctcttttgttgcttgtatatcatgaaatttatctgttggaaaccctatctgtattttcttctgatggtgatcctc

SEQ ID NO: 80925 - DNA, 468 bp, Zea mays
  Clone ID: LIB3088-013-Q1-K1-E2
acgtcaatgcttccagaattaaagtccttcaagctcaggatgatttggtaacagatatgttggagtcagcgagcaaagaactactgtgcataagtagagatcaccccacttacaagaagctcctcaagacacttattgttcagagtttgctgcgcctgaaagaaccagctgtgcttctccgatgcaggaaggaggatcttcaacttgttgatttagttttggagtctgcaaggaatgagtatgcagataaagcaaaagtatatcctcctgagatagtggtagatcgtcaaatctatctgccatctgctcccagtcattatcaggcacctggtccctcatgctccggtggagttgtgctagcttcccgagatggaaagattgtctgtgaaaacacactggatgctagattgcaggtagttttcagaaagaagctgccagagattcgtcagagccttttcgggcaggtag

SEQ ID NO: 80926 - DNA, 423 bp, Zea mays
  Clone ID: LIB3088-013-Q1-K1-E3
acgcccacgcgtccgaaaaaaaaaaacataaaattaaaaaataataaaaaaaacaaatataaaagggaaaaacgggcaatttaggaggagacaaaaaaaaaaacgcatgcatcttacaagatacctcttttataaactcatctataataatttaatacccctgaatattccaactctacttactttaaaaaccctggcttttccaaactttatacctttaaaacccatgcctctttcgactgattccgcattaacaaaaaggccctttcctaatgtcatatccaaccatagtgcaccctatatggcgaattttacaaccctttttcaagctcattaaccattgtgctcctccctattactcccaatttaacccgtacaatttactggttcctaacacccagtcctttccattttttaccttcc

SEQ ID NO: 80927 - DNA, 397 bp, Zea mays
  Clone ID: LIB3088-013-Q1-K1-E4
cccacgcgtccgggcgcaggctgctcagaacaagactaagaaggtgacgatcctcttcatgcagtgcgagaaaccagtgtacagagcgtaccagcttggcctggcagctgcagtgctcctggtagttgcccacgcggtagccaacttcttcggcggttgtgcctgcatttgttcccagctggagttcatcaaggcgtccatcaccaggaagctggcagccaccaccataattttttaatggatcgccctgattgccggattctcgctgctgttcgccggcgccatgtccaactccaagtccaagacgtcgcgcgggttcactcacggacacaccttggccctcagagggaacatgcgctttgtacacggcgggatcaccgtcgtattatacgtcacc

SEQ ID NO: 80928 - DNA, 438 bp, Zea mays
  Clone ID: LIB3088-013-Q1-K1-E5
acggtcaaggatgccatcctgggtgatggtcgatcccatgaactacaccatatgagaccattcggcagctgtgctcggtggctcaatattcaccttttgaggggtgaaaggtgaagcatacacaatcttggatgtcgtggaacactacaaggaagggtgtggctggatgacaacgggattgaagtcgattggcagaagatgctactgctcagcgattgttctctgactgtaactgccttaaaaccaagtgagaatgagaagactgataataggtaaaactaatatattaatattacgtaaaaactaagaatgctcttgcttaacctgaactgacaacactagacacgatggacctcgtagtttctgaatcggcgaactgtaaaacaaacattgagctgtttgtgttgtccgacactggatggttggtggatgcatgca

SEQ ID NO: 80929 - DNA, 353 bp, Zea mays
  Clone ID: LIB3088-013-Q1-K1-E7
ggcgactatgagggccaagtggaagaagaagcgcatgaggaggctgaagaggaagcgccgagagatgaggcagagatccaagtaggctgatggggattgtggatggtggtgtcggcatagttgtgttacgtttcttcgatgcgtgagttcatggagagatgtcacatcctagttcgtcgtcaccgtttgccatgggtccaatggctcgtcttggaaacctgcacttcagtaggccatctatcgtggtttctagctatatccagagttttgtgctaagacaaatcagtcagtcgttttgtgaacctattatgatggagctttatttgctgctaatatcgacctacctattaagt

SEQ ID NO: 80930 - DNA, 403 bp, Zea mays
  Clone ID: LIB3088-013-Q1-K1-E8
acgaggcgccgcacggcgtcctgctggcgaccggcttcggcgcgatcaccggcgccgtgctgggatccgaggtggcggaccactggtaccagctctacgagatggacaagcagggggccaacctcaggttcatctactggtgggaggacaaggtctcaggccagaagagctgaaccacatcgagtgatgcctattctactgagcacaccagcgtgacaacaaaacattgacgtctgtcatgccgagttcttagtttttctttcctagttttctctaataagtgtggaattggttgaggaagccaactggacaatgcatttttcatctccgtcatgggttatgtgcatacatggtcaatctggtgtaaacagcaaatcctatccgatttcgagatatgttttct

SEQ ID NO: 80931 - DNA, 380 bp, Zea mays
  unsure at all n locations
  Clone ID: LIB3088-013-Q1-K1-F1
cgccaaagccggccgtcggactcgcttcaacatcatctcagggacttcgatgtcatgccctcacatcagcggngtggcggcgctgatgaaggcggcacacccagactggagcccagccgccatcaagtcggcgctgatgaccaccgnctacaccgtggacaacacgaactcgtcgctccgggacgcggcggacggctccgtcgccaacgcgttctcgtacggcgccggccacgtggacccgcagagggcgctttcgccgggcctcgtgtacgacatctcgacgcacgactacgccgncttnctctgctccctcaactacagcgccccgcacgtccaagtgatcaccaaggcgtncaacgtctcgtgcggccccccgaaca

SEQ ID NO: 80932 - DNA, 261 bp, Zea mays
  Clone ID: LIB3088-013-Q1-K1-F2
acgctcatggccgtcgccgccttcctccgcgcgaccgatctaccctgcggcaccaccatgtcggtgatcgcgggcgaggacttgcatcatatgctgcgtatgctgaacaccaacttggatgggaagcaaaaaatcatgttcgccatgacctcaatcaaaggtgtccgacgccgattgtcaacatctgatgcaagaaggccgacatcgacatgaacaatatggtccgcaagctgacgcctgatgagctggagcgcctgatga

SEQ ID NO: 80933 - DNA, 372 bp, Zea mays
  Clone ID: LIB3088-013-Q1-K1-F3
acgcccacgcgtccgcccacgcgtccgttacgatataagatccagttttggaatacaggtcgtgcaggaaatgtacaaacagagtagctcggtctccggtttgacgcccaagactcagctcgcggtggcagctgcagattctgcagggtgccatcgtgacgcaatactcgcgttggcatccttcaacttgtctagccagagattggtatcaggcagcagagacggcgctgtcaaagtgtggaaatagcttctccagcatgggtaagattacaagtccacaggcgtgtacatattttggcctgtctagtgctcatacagtacatatgccactagttattgctgtacagaagattattccgatcaatacaagtc

SEQ ID NO: 80934 - DNA, 438 bp, Zea mays
  unsure at all n locations
  Clone ID: LIB3088-013-Q1-K1-F4
ggctgttggagttacaaagagagcagtaccggatggagcaggtctgaggttcctgtgctcgttgtagagagtgattcggttataggtggtgctcgacagacagtagtatcagtggataccaagtcatcgacgcgttggacgcttggaatcaacaaagatggaatcgatgacttcacagttcaagtggattcggagaagatagtcctacctggtgataagagcgagatagatgggtggcatacaatccagtttgcagggggcaagaactcgccgacgaagttccagctgacgctatactggtcgtctagcaaaccatctgagagagaagctaaacaagcagcggacgctcctttgctggtgaaactaagaacagatgtgaatagagtcacaccgcangtggcaagggtggtggagaagctgccacggtggtgcacgccc

SEQ ID NO: 80935 - DNA, 399 bp, Zea mays
  unsure at all n locations
  Clone ID: LIB3088-013-Q1-K1-D3
tcgtaccgcatccaaccgtcaagggggggtctatcctcccatcgtctttcgcccaagtccgttgcccgtgagcctctgccgcgggatgggcagaggccgtgccgcgcttcgccggatggaaagaatgctcgtcattcggcgccatcccgagcctgctctgaagtgtgagctatttggagggccgatatgccacaaagtagaatcaaatttgatcatnnttaggctctnnntcggtgatangnntctagacccaaacatgnntattgagaaatgcccagctgtaaatgcccgtttgcatttaatcagtgtccaattctcacaaattactgcgttcnnctcctaattacatattgtctcntgtcagtggtattaaccttggtgacttaccannnattatgc

SEQ ID NO: 80936 - DNA, 241 bp, Zea mays
  Clone ID: LIB3088-002-Q1-K1-F4
cccacgcgtccgcgttttcatgcgtcatacgtgtcttgctgcttttgaagctccgttcccgggtgcagggacctacgagtccattccgccgtttgctgattctgtttgtcgtgtaataaaatgaaaaccccaccccgttttgaatgaaattcaattctcagtgtcgtgtgaaatatactcgattgtaagagttttgatcttgatgttgtcaaaataacgtccacatgatcggaagtcttgc

SEQ ID NO: 80937 - DNA, 356 bp, Zea mays
  unsure at all n locations
  Clone ID: LIB3088-002-Q1-K1-F5
cgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctncaaggccatgtccatcatgaactccttcattaacgatatcttcgagaagctc

SEQ ID NO: 80938 - DNA, 201 bp, Zea mays
  Clone ID: LIB3088-002-Q1-K1-F7
cccacgcgtccggttgatttgtcggttcatgtgctcctgtaattcacatcacagagagaccagccgatcaataatgtagtttctgaggacatgtttccctgcagtattgcaccttgggagcgcattgtaaatggcctggaacagttgtctactggatttgtttatttatttacaataaaagccatgtgaaaataagtaact

SEQ ID NO: 80939 - DNA, 447 bp, Zea mays
  unsure at all n locations
  Clone ID: LIB3088-002-Q1-K1-F9
cccacgcgtccggctgtggaagacctggtacagcattgaagattctaaatgatttgattcaaaatgaatctgaaccaaagaaaaagctttatgatttgaagatccagttgattgaggagatgggatggaaccatgtctcaacctacgaaaaacagtggatgcaagtccgctttcccccatgtctgccaccattttgattgtgaactcatttttacaatggctctatcatcctgggttcagtagttgtcattttcattgctgggtgcgtcagttcattatttcgatggcaaacagccaactaggcaagctactggatttgtgcgtntggggacacagttattccatagttattttgtggtacaatatcaggggagtcctttctccaaggagataagacggaacagagatattttgatggacttgaaggagatnttatcctcttcaatc

SEQ ID NO: 80940 - DNA, 300 bp, Zea mays
  Clone ID: LIB3088-002-Q1-K1-G12
aaaaaaaaatatacaaaaaaaaaaaaatatagaaaaaagaataaaaagaataaaaggtggaacagaatagaaagaggtatgataaatgaatgtctaatgaacacacctcttttgtcgggtccattctagcctatttcaacacggctgggggggggcgttttcaggtttcccaggttctggtcccctggtcgtgctcttttagctttgttctgcgggattgcaattttttcttttttgcctctctttctctctctctgtgatgggacaactggtgctctttccatattgatagggttagac

SEQ ID NO: 80941 - DNA, 422 bp, Zea mays
  Clone ID: LIB3088-002-Q1-K1-G2
cccacgcgtccgcccacgcgtccgcccacgcgtccgccgtaaacggtttgagcaagaaggaatatcacttgatcagcctcttgttacctcttgtggcactggtgtgacagcatgtgtattagccttgggccttcatcgacttggcaaaaccgatgtcgcaatttatgacggatcgtggaccgaatggggcgcccatcctgacactccagttgcaactgctgtttagtctcttcataataggacgcccgtgctcttcatagaggacctcttgattgtatttgccccgtgctgtgattctatggaggttggttggatgcttggatgtaaagctggggaagcgaagccttttggccttcactgtaaaagctgcaacagaaaaaactgtcacatgcacttgaatataagataaacttccctgatct

SEQ ID NO: 80942 - DNA, 362 bp, Zea mays
  unsure at all n locations
  Clone ID: LIB3088-002-Q1-K1-G3
aggcaagcacatatttggaatcaaaggatgaagttcatgattttgcaagcctgcgacatgcagttcttgaacaggagctatacagtatacaaagcctgttggctcaggagaaggctagagaaacaacatatcgacaaagattacaaacaccacaattgcaaggcctcatccaggagcaaaatcccccaatcgatctctgtggtcttcacatcagcgaggcaatacacgtcctgaactacgagctcaacaaccgaagaaagatcgtgagatcaaccggtcgccgactccaggttatgataatatcaagcgctcgcaccccagcaaggctgactgccgncgtcgagcagtatctcatggaacac

SEQ ID NO: 80943 - DNA, 203 bp, Zea mays
  Clone ID: LIB3088-002-Q1-K1-G4
gtcaaatcatctagtcccaacaatgtgtcttatgtttcttgttacaccatccttataaaagggcaattctgttgcagatattcctcaatgttgcctgctgttttattgagcctcaaaaaaaaaaaaaaaaaaaaaaaaaaaaaaaaaaaaaaaaaaaaaaaaaggacaaaagatataaaaaatccaaagatacatacgataaa

SEQ ID NO: 80944 - DNA, 356 bp, Zea mays
  Clone ID: LIB3088-002-Q1-K1-G5
caacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgcccccggtgtgctctccatggccaacgccgggcccaacaccaacggctcccagttcttcatctgcaccgtcgcgaccccttggctcgacggcaagcacgtcgtcttcggccaggtcgtcgagggcatggacg

SEQ ID NO: 80945 - DNA, 378 bp, Zea mays
  unsure at all n locations
  Clone ID: LIB3088-002-Q1-K1-G6
cggacgcgtgggccagtgcacgcctgattatgcttatggagccggcgggttcccagcctggggaattcaaccaaactcagtgcttgtgttcgagattgaagtcctcagtgcccagtaattcgcatctgtcagctatggaaacgttggccatgcttctcaagtaatgaaataattccgttgtcacctcatgctacatacagcagattggtgttacgagttaaatcctgtgaaactttagcattctgtaaccgtggatgtcgagtttatggagttccttgtgtggcgcctcaagtcaagttctcgtcaaagattgtaatctgatggcttccattgtgacttgtangcggctgcaataaacttacttgatgcaattattgc

SEQ ID NO: 80946 - DNA, 384 bp, Zea mays
  Clone ID: LIB3088-002-Q1-K1-G7
acttgccaaacgcctgaacgaaggaggaggggcgagacatcgcaaaggagctcttgaatgacctcctcgacggcacttcatcatccaaagcgaacaagaacgacgacgaggagcactccgccagcaccgctggactcttcatcttcaacctctccgtcggcacatcctccccgcagagcatgcccggcatcctggacatcgccagccagctcgtttggtggcagctagtgcgcgccctgcagcaacgccggcgactgccttccggcgcccatcttcctgcccaacagctcggccaccttcgcgcggccttccctgcggtgaccagaagtgcaagctgctcagcgagaccttgccctgcgacgaggacacctgcgattacatagc

SEQ ID NO: 80947 - DNA, 84 bp, Zea mays
  Clone ID: LIB3088-002-Q1-K1-G8
gtttctgttgggacagtttcctgaaattatgttttgccctaggataatcttgcagttatggaaccttgttatattgtatcctgc

SEQ ID NO: 80948 - DNA, 237 bp, Zea mays
  Clone ID: LIB3088-002-Q1-K1-G9
cccacgcgtccgcccacgcgtccgttagggttccacgagagctgatctattatgtgggtgtggcggcggcaaatatgcatggatgggatgagcggtgtacttgtgacctcatgttagtatcagcttgtggaatactatgaaaaatgcaggtgccaatgcctttcaccatgctactagttagtttgtctgctacttgttcccaagtttaagaatgtgatcaactgtgacaccttgttt

SEQ ID NO: 80949 - DNA, 415 bp, Zea mays
  unsure at all n locations
  Clone ID: LIB3088-002-Q1-K1-H11
ctttttagttcttggttgggccttttcagttttcaatacatcttcatctgaagcttctcttgatgtgcaagggtctcagccatgtgcttactatgcacaccatgggtattggcaagtttgggcccacatgcaagtttgatcacccgatgggtactccaaactatagtatttcaacatcttcacttactggatgtgccaatcgcttcatatcctcaaaattttccttgtaactcctgtgccttcatatctgccatcttctgatctgcgtncacaatacactcaagtcaaggattcctctgctaatccaccaccatcgnctggaactacttatggtcctgttgggtctatatcaaaggtttatgctcctnacacgcttaatccgatccccgcttctgcagctgctggcatgcaagcg

SEQ ID NO: 80950 - DNA, 400 bp, Zea mays
  unsure at all n locations
  Clone ID: LIB3088-002-Q1-K1-H12
gccatgaacaaggacccgcgcttcaagaaccgctacagcgcggcccagttcccctacaccctgctcttccccaacacctccgacaagggcgataacaccggcgtcaccgccaagggcatccccaacagcatttccatctgattcgatcgagtcctggccagcgtttcacccaaaaaagcagagctagcggtgattcccgtatgtcatccgtttcattttttacatgaatgagaagcgtggtaataaaaaggtttgtagttgcgtgcgcgccgtgtattccttggtgtactggtgctggcggtaaccacttattaccagggatccttgtaattnttcctggtggtttcccaaataataatgtgaatatatgggtccaaaaaaaaaaaaaaaagggccggcc

SEQ ID NO: 80951 - DNA, 65 bp, Zea mays
  Clone ID: LIB3088-002-Q1-K1-F2
ggttatcacttcaaaaaaaaaaaataaaaaaataaaaaaaaaaaaaaaaaaaaaaggggataaaa

SEQ ID NO: 80952 - DNA, 334 bp, Zea mays
  Clone ID: LIB3088-002-Q1-K1-D4
gcgctgacgcatgggcaatgctcaagaggccaatggcgcactctgtgaaactcaaacctggtaccaggagatgctaaatctgagggcactattctaggtcttaacgcgcactcataggcactacgattggactggaactcggcccactgagtgctaaggagttgcaccagctagagaaacagctcgaatgtgctaagtcacacgcaagacacataaagacactacttatcatggaccaagtgaaatagctccgaataaaggagcgacacttgggagaaattaacacgcaacttacacacaatcttgaagctgcaggttgtagcaactacggaac

SEQ ID NO: 80953 - DNA, 377 bp, Zea mays
  Clone ID: LIB3088-002-Q1-K1-D5
ggcccttcctttgttcagcacaccgtcaggcactgtaatgtgttcagcgatatccctcggttttcttgctctaggaagagcagggtttgccgtgaaccatatggatgttgctccgaagtttgcagggatagtgatgggagtctcaaacacggcggggacactggccggaatcgtcggtgtcggcctcacgggcaatattctggaggcggcaaaggcttctaacaaggatctaacggactcggaaacctggaaaacagtcttcttcgttccagcatatctttgtattttcagttccgtcatttttttgatcttttcgacaggcgaaaagatctttgaataaagggtggttattactttttttgccaattcttttctta

SEQ ID NO: 80954 - DNA, 393 bp, Zea mays
  Clone ID: LIB3088-002-Q1-K1-D6
aagactcctttggtgtggaatagttgccatagtagctcttaagggttagtttgacggcctcattttccaagagattttcattttctaaaattagttcatttttacttgaaaaatgagaatcctttggaaaaatggagttaccaaactagcctaataaaatttatttatatgaccaggtgaaggccatggagttgattgataagttggaagttacgaggcgaggaccatatagtggtggtctaggaggaatatcgtttgatggtgacatgcaaattgcactttctctccgcaccatcgtattctcaacagcgccgagccacaacacgatgtactcatacaaagacgcagataggctttgggagtgggtcgctcatcttcaggctggtgcaggca

SEQ ID NO: 80955 - DNA, 305 bp, Zea mays
  Clone ID: LIB3088-002-Q1-K1-D7
aaaaaaaataaaaaaaaaaaaaaaaaaaaaaaaaaaaaaaaaaaaaaaaaaaaaaggagaaataattaaaaaaatgataaaaaaataataattttaatttatttataatataataatttttcttatattgtaaattaaatgtaactcaactgattctatttttttatcttcttgtctgtttaatgcgtttttttacctattttgattgttttgttttacatctttttttccttatttacttgatttttactaggtctgatcttatttctctttagattatttgctctatctttatgattattggt

SEQ ID NO: 80956 - DNA, 447 bp, Zea mays
  unsure at all n locations
  Clone ID: LIB3088-002-Q1-K1-D8
aagaacttgaaagtacaggtctgtacttcgaggcggctttgaagtttctgcatgttgcgtttcttctagaaactcctagttttgacatttcaagacaaggtggtggaggtcggtcaatgaagatgtactctgaaactgcaaaattatgcaatttttgtgcttatgaatatgaacggtgcaaaaaaatggcttctgctgctttagcgtacaagtgtgtagaagttgcttacctcaaggctgcatactacaaacaccgtactgctacaaaagatcaacaggaacttcaggcagctgtacagataacccgaggtgaaccaccatcgccttctgccctagatattgataatttaaatagccatggatcatcaaatgcctnctcattaaagggtgacaattcacctcatgtgccaggcaatcatttgcctctagctattcacaaccaagccc

SEQ ID NO: 80957 - DNA, 339 bp, Zea mays
  unsure at all n locations
  Clone ID: LIB3088-002-Q1-K1-E1
ntccgccacgcgtccgtccacgcgtccgactagcttcaggaaaggctggaacatctaggcggccaatagatgacgagagcttccaggaggaggctgaagatgtagaagaacagccgttagttaggcgtcgttctcggcgtgccccttctgaggacaatgaattaccaaaaatagtgcacccaggtgctagccctgttctgaacaatcaccagtataatggagatgatttcccatctgagtggggtggcatttcttctgaggaacatgatgaagctgttatgcttgaggctgcaatgtttggtggagttcctgaaggaccaacatatcctttctctatgc

SEQ ID NO: 80958 - DNA, 438 bp, Zea mays
  Clone ID: LIB3088-002-Q1-K1-E10
cccacgcgtccgcgcgccgccgccgccgccgcttcgtcgtctccgccgcatcgtcgtctccgccgcagcgatgccgtcgcacaagaccttccggatcaagaagaagctggcgaagaagatgcgccagaaccgccccatcccctactggatccgcatgcgcacggacaacaccatcaggtacaacgccaagcgcaggcactggcgccgcaccaagctcggcttctgagcgcgcggatcggccggctcctgcgtcggaattctagggtctctacctttcctttggttttatcgatgtctcttgtgtttctgtaagctagcaaacggttccagaaagcttttgttaagattttgatgacgctaagaggatggatgctactatgctgtactcaggattccatgctgcattgcgatgctaaattaagaacctttgctaccctt

SEQ ID NO: 80959 - DNA, 292 bp, Zea mays
  Clone ID: LIB3088-002-Q1-K1-E11
agaaaaacaagcagaagctgcttggaaagaaagtgagtatcgcgcgatcagatccaagcaagggtaagaagagccgtgaagcaggtcaaacaagccaggataatttacctccgagtggtggtgatgatgcaaaagcaacaggatccagtggaccagacaatgaagtacccaagggtgatgcaaaaaccatagggaagaataccctttttgcaccacgagctctggttaaacctcttggatggacaaacaaggatgagaagaaaccagatgttgcaagggagttgaaatcaaa

SEQ ID NO: 80960 - DNA, 352 bp, Zea mays
  Clone ID: LIB3088-002-Q1-K1-E12
cttgcggtgcgtatgcttttcggtgttttgtgtcagagcgagcaatcacaaagcaatggagagcccagcttgtaggaaccacatcgatgtatagtagttgatacgcatgtactgactaatttgagcaagtaaaatgttactgctcacaattatagcacacggttcatctgtgaaaacaaatatgctcatctaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaatcaaaaaaaagaaatacagaaaaaaaaaaagggggggcctcttttgatttaaaacctatatga

SEQ ID NO: 80961 - DNA, 109 bp, Zea mays
  Clone ID: LIB3088-002-Q1-K1-E2
aaaaaaaaataaaaaaaacaaaaaaataaaaaaaaaaaaaaaataaaaaaaaaatgggtgataattaaaaaaaagaacaaaaaaaaaaaacaaaaaagggcaacctatt

SEQ ID NO: 80962 - DNA, 126 bp, Zea mays
  Clone ID: LIB3088-002-Q1-K1-E4
cccacgcgtccgtctgtacagaatagtcatttgttgccaaaacgatcagtgttaccatgtgttcggcttgcttgtgtctatcctttcttgtgattgagttcgactttcagagtttgcaatgcgacg

SEQ ID NO: 80963 - DNA, 294 bp, Zea mays
  Clone ID: LIB3088-002-Q1-K1-E6
cccacgcgtccgcggacgcgtgggcggacgcgtgggaaaatttgcaccattcgggagtcgtagtattgcctgtatccatggacgccagctgagccggtagcatggggaagaagggtgcggtcgagctcatggcaagctgccccaggaagaagtctttgacgcggtccgttaaggccgagctgaaatttcgcttctgcttgatcgggcgctacctgaattatggccggttcgctcagtgcgtgggcactggcacacccgtctacttcgccgtcgttctggagtacctatgcgtct

SEQ ID NO: 80964 - DNA, 292 bp, Zea mays
  Clone ID: LIB3088-002-Q1-K1-E7
ttgcgagtttcttctaaagttgaaatgaagccatcaccaaatgtagcttcggtgtgccatctgtttactcagttagatcatgtagtgtatcagttgtgtatctttgttgttgtgcttcgtgatctcaatttatttctttgtgcacctagaggttgtcaaataatggtaaccgatatgttatctaaatatctaataatgattatgtgattgtgatttgggccgcatcactgctgtaaagtgtaaacccttgtctctgcaacatgagttatcaacaaatttaagatttgaatgt

SEQ ID NO: 80965 - DNA, 240 bp, Zea mays
  Clone ID: LIB3088-002-Q1-K1-E9
cttgtcaggttcaggctcaaacattgcagatgcaggctgaggctgcattagctgtgcctggtagttggtgcatgctgtgtatcttaagggtcacagcactagtagtgtacaactaggaatatgtgtgtcgaatccatttgtaaaatagcagccgttattgtttgtgtggtactgatccagcttttttttagaagaaaacatgtgttgccatcccgagatggctggacaggtgttgctact

SEQ ID NO: 80966 - DNA, 347 bp, Zea mays
  Clone ID: LIB3088-002-Q1-K1-F1
ggagggtgaagcaccgccgccgtctccgccgccgccgcacaaagacgagaggaagaggttcccggcgccgacaccaccatgtcgtcgatgatgaacgcgctggcaaactggctggcgaacccgcgccgcaacccgctggcgcgtctccacatgcacgccgtctcctcgcgcctcaggaaatacggactgaggtacgacgacctctacgacccctacttcgatctggacatcaaggaggcgctcggtaggctgcctagggaggtggtcgacgcccgcatccagcgcctcaagcgtgccatggacctctccatgaagcaccagtacctcccggaggaccttcaggcaca

SEQ ID NO: 80967 - DNA, 407 bp, Zea mays
  Clone ID: LIB3088-002-Q1-K1-F10
ggagaccatcgccaggctgagctcgctccccggcgagatatccttcccctgcggacttccctcgctccgcttcttcatcgacaacgtcgaggatcctgttcctaatgacccctttcagttgctcccgaaaagaacttaccagcccagtacaatcaagcggaaaagaacccatggatttcttacgcgtaaatcgaccaagggtgggcgcaaggtgattgcccggagaatcgccaaaggcaggcacagaatctcagtttagctagagcgagaaatctcagtttagctagatctcgctcgtagcagccctggatgttttctgtaacacagattcgtatcgtgttggttctatggttagcactctgctgaaggtgagcccccgcgcaagcagcagtccatgtatggatttt

SEQ ID NO: 80968 - DNA, 421 bp, Zea mays
  Clone ID: LIB3088-002-Q1-K1-F11
cgcacagatgattgatgatgctgagggcctggacaagattgagaacctacagagccatgacaacactgagatatatgagaaggctgtcaagatgctcgaatcttactggctagaggaggaagatgatgccatgccctctggcgacaatccccagaatggcttcaactttgggaaccagccctctgttccatcaggtggattcaacttcggctgaagatgcccatttggaatggcggctgtgccattgtgccttggcctagtggttggggctagtcagagttggggtagtggcgtcgtcctccaaaaccttggttcggtcccattggtctggtctcaggtgtttgtcatgtcagtcccagtcagcagggtcagtccttgtgctgcatcaccagtggtgctgcatggaatggtcagtcttcag

SEQ ID NO: 80969 - DNA, 369 bp, Zea mays
  Clone ID: LIB3088-002-Q1-K1-D3
atacaagagccatcagatgaggtggataacttggcagagaagacagagagcttgactgtaaccgagtctagtgagccaagctttgcgggcatgaaaaagaagaagaagaaacatgtggaacttgattcttctcttaccgagaccggagatgttgatgacacaggagacgatcaagttagagaggatgaagaaggagaagggattgtgctcgctggtgccgctgccaccagatacccttgggaaggaactgacagagattataagtatgaagagctgcttggcagagtattcaacattttgcgtgagaacaacccggatcttgctggtgatagaagaagaactgttatgaggccccctcaagtccttaag

SEQ ID NO: 80970 - DNA, 401 bp, Zea mays
  Clone ID: LIB3088-002-Q1-K1-F12
aaactctagctgatgggctgcatattctctcaaaggaaaaaacgggggttgcagtcattgacaggaaaaccagccgtctaattggatcattacagtgcagtgatctctacctgtttctagatgacagcacccttttcagcaagcgaacgacaactactctggaagaattaatcagcctgaataacaagaccgacaggaaatgcagcaccgctgaaaattcatgtgcgcctggccgaaacatcctcgcgctcaggagcaggcagtcaggcatggtgggcctaccagccaccaacctggaatccgacaccctaaagcaagcgatggagaagctgacaactttaaggagcagctgcagcttcatcgtcgacgagcacgggcgcgttcaaggagtggtgacccac

SEQ ID NO: 80971 - DNA, 292 bp, Zea mays
  Clone ID: LIB3088-002-Q1-K1-B7
caagaggaaaatggaggagcataaaccaaaggagcagaggcccaaggccaacgaggacaagcctgtgatgaacgaatgagtatctgcagaagctttgttcaatgtgcaaccaagtccgatgtccgtttgctctggttagcttaaaaccaacgcttccaataatcctattggtgtcttagtttccccttatagtgttatttgctcggcttgaacatggcatacggaaatgaaacttgaactacctatggtactgtcatcaatttgagacccccatgattgacaaaataaatga

SEQ ID NO: 80972 - DNA, 269 bp, Zea mays
  Clone ID: LIB3088-002-Q1-K1-B8
aaacgactccatggatttcgtttgaggacaatataccggggcaagtattacatcgtataccaactgcagttcagcaccgtaaagatagctagtgtacaatgcatgcatatgcctcattggtagtgtagtttagttctttgtatcgttaatctggaagtggctccagtatgtcaaaatgctgttttattttcttctttcctgggttgtggagtaatgtgttagacagaactagccacctttagcaatttatgtaaatctttttagccttt

SEQ ID NO: 80973 - DNA, 64 bp, Zea mays
  Clone ID: LIB3088-002-Q1-K1-B9
ttcgtttttccatgtttccttgtctccagacctggacttggactgctattgatttttgtttcag

SEQ ID NO: 80974 - DNA, 286 bp, Zea mays
  unsure at all n locations
  Clone ID: LIB3088-002-Q1-K1-C1
cagtaccgtccggattcccggtcgacacgcttcggcggattgaggggggatctcgcctatagattccnctctttcatggattttgatgcgatcgtaatattgtcagtagctctagattcgtcggtagctccagcatgagtgtcggtggtagttctgtgcctgtaaaaacttgggatagttgatcgcgtgtgatcagccgtcatgctcctacagtctctatgaacaagctaagctataatagtattttgctatcctatgatccccgggttgttggcttattgttgtc

SEQ ID NO: 80975 - DNA, 399 bp, Zea mays
  unsure at all n locations
  Clone ID: LIB3088-002-Q1-K1-C10
cttgggaattcttctgcagccaagtatgatcagatgcacgagtggaagtactacaagaaatacgaggaagggctccgagccaggactggcatttcccagggccccaggtccactccagcagaagagcttgcaaaggcggtggttgcatcggttctaaagaagaaccctccagcttggttcgcttacggccagtactctgctattctgtcgattttgtattatgcaccgctatggttcagagattgcctctataagtttgtcatgaaatgttagtccctggaagaataatggctgtatggaccaaagagagagctggacaggcccagttcaaancatttcattgtactgacaagcctgtacgtcgtactcctataatggatatttagaactatgctctgt

SEQ ID NO: 80976 - DNA, 438 bp, Zea mays
  unsure at all n locations
  Clone ID: LIB3088-002-Q1-K1-C11
cccacgcgtccgatctcctcgcatttcttcccatccgatccccccttcgcaaccaaaaccccaactcgccccgcatcgatggcgcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgncaagctcgcgcgctataacaagaagcctaccatcacctccgtgagatcc

SEQ ID NO: 80977 - DNA, 186 bp, Zea mays
  Clone ID: LIB3088-002-Q1-K1-C12
attcagaattcttccacctttgccacctgaaattgcaaatgaatctgtcttggcagaccatttctcatcatttggggatctttcgtcggttggcctggaagatactggagcccataaccttgatgcaaccctaaaaccttcgctgagttgctcagcttgggggacttacacaacacgacaatcaac

SEQ ID NO: 80978 - DNA, 251 bp, Zea mays
  Clone ID: LIB3088-002-Q1-K1-C2
gcggcagcggcttcggcgcgggcccaacctcttcttccatggagtgaagttgcccttggtttggacatggtgtttcccttcgcatgtggcctttagttttgaaggacagttattatgtactagtaatattactcggatcggccagtgctgacatatgcaaaaaaatgttctgtcgttatacattggttccaaaaaaaaaattaaaaaaaaaaataatatgaaataaaaaaaaaatataaaataaaaaaata

SEQ ID NO: 80979 - DNA, 331 bp, Zea mays
  Clone ID: LIB3088-002-Q1-K1-C4
gactatcatcctaggttcgggggtgcttgcgttctgccttaacttctccatcttgtaggtcatccattcaacaacagcagtgacgttcaacgttgcaggcaaccttaaagtcgcggtggcagtgttagtgtcgtggtcgatcttccggaatccaatctctgcaatgaatgcaatcgggtgtggaatcaccctggttggttgcactttctatggctacgtgaggcatctgatctcgcagcggcaggctgcagccccagggagtctaggaacagcgcatgcaaggaatcagacggagatgcttccccttgttgtggacgagaagcaagaaaag

SEQ ID NO: 80980 - DNA, 380 bp, Zea mays
  Clone ID: LIB3088-002-Q1-K1-C5
gactatcatcctaggttcgggggtgcttgcgttctgccttaacttctccatcttgtacgtcatccattcaacaacagcagtgacgttcaacgttgcaggcaaccttaaagtcgcggtggcagtgttagtgtcgtggtcgatcttccggaatccaatctctgcaatgaatgcaatcgggtgtggaatcaccctggttggttgcactttctatggctacgtgaggcatctgatctcgcagcggcaggctgcagccccagggagtctaggaacagcgcaggcaaggaatcagacggagatgcttccccttgttgtggacgagaagcaagaaaaggtttagcaatggtgctaggccttctcttcacttggtgaagagagaatta

SEQ ID NO: 80981 - DNA, 351 bp, Zea mays
  Clone ID: LIB3088-002-Q1-K1-C6
gaaagaacttgtttcgaagttcattccagaagttattggtaaagagattgagaagtgtacctccagcatcttcccacttcaaaacgtcttcatccgcaaggtgaagatactcaaggcccccaagttcgatcttgggaaactcatggaggttcatggcgactacaaagaggatgttggtgtgaagcttgagaggcctgtcgagggagatgaggctgggcaggaggttgctgctgccgagtagtttgtttgctacttctgtatctaggcgagtctggacatgaggttgcttatgacgtgaacttattgagttgtcttggctacgtgttttcatctggccctaagattttgtct

SEQ ID NO: 80982 - DNA, 354 bp, Zea mays
  Clone ID: LIB3088-002-Q1-K1-C7
ccgcattcgttccaactcctgagcactttctcctcgtcccagacaagccaatcgaagccgagatacgaccatggactccaccggcaccggagcagggggtaaggggaagaagggagcggccgggcgcaaggtcggcgggccaaggaagaagtcggtgtcgaggtccgtgaaggccggtctccagttccccgtcggccgcatcgggcgctacttgaagaagggccgctacgcgcagcgtgtcggcaccggcgcccccgtctacctcgccgctgtcctcgaatacctcgccgctgaggttctggagctcgccggtaatgctgccagggacaacaagaagactcgcattattccggg

SEQ ID NO: 80983 - DNA, 451 bp, Zea mays
  unsure at all n locations
  Clone ID: LIB3088-002-Q1-K1-C8
cccacgcgtccgcacgagcggatagcggcgtacagatcttttcgtgctcgtcttcgcgccggtacaacgacgaggacgtcgtcgtcggtgtgatactaggcactggctccaacgccgcgtacgtcgaagaggccagtgccatacccaagctcaagctggagggcggcgaattgcccaagtcagggaacatggtgataaacacagaatggggtaacttctactcgccctgcctccccatcacggagtatgaccaggccttggatgaggagagcttaaacccaggggagcagatcttcgagaagctggtttcgggcatgtatctcggcgagattgtgaggcgggtgctgcttanaatcgcgtcgcagtctttcatcttgggcgatgtcagccacacgaacctcaaaactcgctttagtcttaggactccggacatctccggaatgcaccatga

SEQ ID NO: 80984 - DNA, 455 bp, Zea mays
  unsure at all n locations
  Clone ID: LIB3088-002-Q1-K1-C9
gccttctgcgtgtacgcagctgtttctccttcgattctcttcgtggggaaatcgttgaccgggattttcccagcaatcagtttgataggcgacagcgtgattgtcgggatcttctacttcattggctttgcactgttctgcctagagtctttgctaagcatgtgggtcattcagcgtgtttacctctacttccgaggaagtgggaaggaagcggagatgaggcgggaagcagcacgcagtgctgcgagggcagcattttgacgaaccgtgtatatattatatagcacggcgtgcgttttgttcatagtttgaagtgtttgtagatcaacatacatatgtagagtagtgttgccgtgttggtgtactgtaaatcttcagaatttttcttaccagtatttttagccctaataatanaattgtaatgatgatctcactcagcctttaggaaaaatttt

SEQ ID NO: 80985 - DNA, 346 bp, Zea mays
  Clone ID: LIB3088-002-Q1-K1-D1
cggacgcgtgggtagctgacgctttggctgaggttaacgaaggaaagattccagaggatcgagttgcacttcagttgcttgccaaggagatggcagaatggccagacattgagatagaagctccaaaaaagaagagcaaacctgggaaatctgtctatgcaaaagccacagatactggcatcgatcctgagacagctgctaaaagacttaaccttgactgggactctgctgctgatatagatggcgaagaggaagacgatgatgaaactgaagtgccgtctgcagtgggatatggtgccttgtatttgttgacagcttttccggttattattgggatctcagtcgt

SEQ ID NO: 80986 - DNA, 187 bp, Zea mays
  Clone ID: LIB3088-002-Q1-K1-D10
gtcttttgcatctggagtcaatgtgaacaagcagattgtcgtattgtctttctcgtaataaatttgtcaatgttgagcccttaggcttgaattgtgggaccctttgttcgttttcctagactctgatgctgtatgcaactgaaacgagtaaatctatgatcttaaggctgcagtatgttcttgtgtt

SEQ ID NO: 80987 - DNA, 421 bp, Zea mays
  unsure at all n locations
  Clone ID: LIB3088-002-Q1-K1-D11
agaaaatccacgattgtcaacatatgacagacggctcccctgctgtggctgtggaataggttggtcttgttttcttctaggtttcttgtgccctatcatttggtacgttgcagctcttctctattgctgcaagtactataatcgggatcctcgtgaacggactggactcgcagcttccgctgttctggcggttatcattacagctgtaactattgtaaccctgtctgttctgctgatatgttgtgtcaacaaacggttcttgaatagctgtgcagtttggcctaagtgatagcagcaagatatctattgcaaaacatcagcgttgaactactaactgaaatattctttagattctttagtcagtgcacttattgttggactgcanaaaggaaatcaacaaattatgtgtaacatgatccat

SEQ ID NO: 80988 - DNA, 358 bp, Zea mays
  Clone ID: LIB3088-002-Q1-K1-B6
attagcttcctctacccgagtggagttgatcggttcaaacggcagtttgcacatcttgaggagcattatagcaagggagaaagaggttctccactgcaaagaaagcatgcttctttaccaagggaaagagtggttgtatcgaaggacggtgatactgagcaacatattaatgaccaggagagaagtgcagattctgtcgcccgcaccactgtgagccctccaaggtcagaagacgacgacatgagcgatgtgacatccacaagcttgagctctcggagctacctgaaaagtgcgagcataagtgctttcaagtgtgtcgttgccacgaagaaacacccggaggacaatggaatcactg

SEQ ID NO: 80989 - DNA, 163 bp, Zea mays
  Clone ID: LIB3088-002-Q1-K1-D12
cccacgcgtccgcccacgcgtccgcccacgcgtccgcccacgcgtccggatcaaaccagcagccaaggggagcttattggctgttgaagcctgatgcaaaataaagtacgaaactatgttttttgtttaactaataactagcaaacatgcttccgttgcattg

SEQ ID NO: 80990 - DNA, 470 bp, Zea mays
  Clone ID: LIB3088-002-Q1-K1-D2
gaagggtctgggcaaaggcggcgccaagcgtcaccgcaaggttctccgcgacaacatccagggcatcacgaagccggcgatccggaggctggcgaggaggggcggcgtgaagcgcatctcggggctcatctacgaggagacccgcggcgtgctcaagatcttcctcgagaacgtcatccgcgacgccgtcacctacacggagcacgcccgccgcaagaccgtcaccgccatggacgtcgtctacgccctcaagcgccagggtcgcaccctctacggattcggcggctgagaggcgctaccgccgctggtggccgtggcaaaagtcttgggtcgcggtcaagaaatcgagagtattctggatgacgtgcttaggttcgtagtatttattatcactagtgcttattgttagccggtgttgggtcgaccactctaagccactgtcaaacagtaatatatgagtaccgaatttc

SEQ ID NO: 80991 - DNA, 392 bp, Zea mays
  unsure at all n locations
  Clone ID: LIB3088-032-Q1-K1-A9
ccccgcgccgctatggacgctgttgactcggtggtcgacccgctccgcgagttcgccaaggacagcatacgcctcgtcaagcgctgccacaagcccgaccgcaaggagttcaccaaggtcgccgcgcgcactgcgatcggcttcatcgtcatgggattcgtcggcttctttgtcaagctcatcttcatccccatcaacaacatcatcgtcggctccggctgatccatgcccctcactccctcaggagtggacaatggcgtctccgccttggaggcgcagctctggcatccggaaagcagtttgtttaggtgaaggacgagtcccgtggtagacctgtaactctnttgtgcctgatgccgaatagtcgtatgtgaaagaagaaaaaattaaaa

SEQ ID NO: 80992 - DNA, 305 bp, Zea mays
  Clone ID: LIB3088-032-Q1-K1-B1
ctgtccgctccgctccccctacatttctttgctgtttagtacataattctagatttacagaaaagacaaagtttactcttttctggatcatatgttttgtgctacttattgctgttctggccgcattgggccagcatgcagttattcacgggttcaacctgacaagcgctggctgcagcagcgaggtgtttgtaggtttcgcggtgattcgtctacccaaatctggaaccgtactgatactgaagaccgtactgatactgaaggcattatccggcgtaaactgttaattcaaacattattacacg

SEQ ID NO: 80993 - DNA, 351 bp, Zea mays
  Clone ID: LIB3088-032-Q1-K1-B10
gcggcggctcgatgaccacggccacgcgctcggtggtcagtgcccacgcccagcaggccggtccagacaagagccggcagcaggagcagccgccgccgccgccttcttcgttgaaccagacggcggcgaggctcctgcgcgaggccaccgtctcccgcccggacggcgagaagccggcgtcctcggacatcctggccttcgcgcgctccgtcgaccgcgtggactcgcctctcgagtagcttttttttggcttgcccactctcagtcagctactggctcactgtgctttgttcttttcttatccatcttgtgttcgcaccgtaataaaaaagggtcaacactttccttcct

SEQ ID NO: 80994 - DNA, 415 bp, Zea mays
  unsure at all n locations
  Clone ID: LIB3088-032-Q1-K1-B11
aatctccaaacgcagcagagcccctagcgccgccggtctcttcagcctcgcagcacaccgccgccagcccgagtgaccgctgcagcctagggtttccggcggcgatggcgggtaagggagggaagggtctgctggcggccaagacgacggcggccaagagcaccgacaaggacaaggacaggaagaaggcccccgtgtcgcgctcctcccgcgccggcctccagttcccggtgggtcgcatccaccgtcagctcaagtcgcgtgccttcgcgcacggccgcgtcggcgccaccgtcgtcgtctattccgccgtcatcctcgagtacctcaccgncgaggtcctcgagctggccggcaacgccagcaaggacctcaaggtcaaacgcatcaccccgcgccacctgcagcttgccat

SEQ ID NO: 80995 - DNA, 338 bp, Zea mays
  Clone ID: LIB3088-032-Q1-K1-B12
cccacgcgtccggccggagcagccgcagtcccggcgatcccgccgccggtcgccctcatacttcctcgtcactgccttcgtttctctttccaacaatcaagatgagccgtggcggtagcgcgggtggtggtcaaagttctctgggttacctctttggaagcggtgagccccccaaaccagcagtggcaccagctgtaagtgctccacctgctgctgcaggtgctccacctgctgagaaaccacctgctgcaaagcctgatggcaccagtcagattgctgctggggttaccagccaaaccaataactaccacagggccgacggtcagaacaccgggaaa

SEQ ID NO: 80996 - DNA, 447 bp, Zea mays
  Clone ID: LIB3088-032-Q1-K1-B2
agcaggttgaagtacgcaagaaaattgagtactctatgcagttgaatgcttctcgcatcaaagttcttcaagctcaggatgatctagttaacaaaatgaaagacgatgccatgaaggaacttctccttgtcagccacaaccaccatgaatacaagaaccttttgaaagacctaatcattcagggtttgctccgtttgaaagagccagcagtattgctccgttgccgcaaggatgatcaccatcatgtggaatcagtgctgcattcagcaaagcatgagtatgcatcaaaagcagatgtccatgaaccagagatatttgttgatcatgatgtatacctgccacctgccccaagccatcatgatgctcatggccagttttgctctggaggtattgtattggcttctcgagatggaaagattgtgtttgagagtacacttgacgcaagac

SEQ ID NO: 80997 - DNA, 428 bp, Zea mays
  unsure at all n locations
  Clone ID: LIB3088-032-Q1-K1-B3
cgtagctctcggtttcggcgatgtcggggcgcggcaagggcggcaaggggctgggcaagggcggcgccaagcgccaccgcaaggtgctgcgcgacaacatccagggcatcacgaagccggcgatccgtaagctggccaggaggggcggcgtcaagcgcatttctgggctcatctacgaggagacccgcggcgtgctcaagatcttcctcgagaacgtcatccgcgacgccgtcacctacaccgagcacgcccgtcgcaagaccgtcaccgacatggatgtcgtctacgcgctcaagcgccagggccgcacgctctacggcttcngcggctaggccgtctncccttctgatgctttgatgtgaccgccgtggtcggttgtgtgtctagctggccggtctactgtagtttggtctgtatcttcgtttcga

SEQ ID NO: 80998 - DNA, 446 bp, Zea mays
  unsure at all n locations
  Clone ID: LIB3088-032-Q1-K1-B5
tcgcccacgcgtccggagtaccatctctcgtcgaaagatgggaacccttttgcccggaccatgctgctgaatggagcccctcttgagctcactgaagatggtggcatcccttcattgtatccagtggaagtttcagttaactcgccaatctatgttgctcctctgaccattgcgtttgtcgtcttccctgactttgaggctgaagcttgtggccgataatcaactgtacatagaatatcacctttttttgctataaggcatctaaagaacaaaggtcattgtaatgtaaagacgtgttcgttttctgatctgtgccccaatcgggccatctacgttttcccaacgaatagtctncaggtgatgtcatactgatcaatgcctcgtcattgtactttgtacatacagttcatcatctcagaaaagaaatggtcaacattaaccaaaaa

SEQ ID NO: 80999 - DNA, 179 bp, Zea mays
  Clone ID: LIB3088-032-Q1-K1-B6
tcagactcgttggcagacgcatttgcagatagatgacttatccgtgtaacttgggactctacttatatattgtatgtaccagctgctcaaaaaaaaattaataaaaaaaaaaaataatacttataaaaaattaataaaaataatttaactaacaattttaaagagaaaataaattaaag

SEQ ID NO: 81000 - DNA, 261 bp, Zea mays
  Clone ID: LIB3088-032-Q1-K1-B7
tcgtggaagatagtgaagccgttcctagaccatgagacccgcaagaaggtgaagtgggtgtactacaacgacaaggagagccataagataatggctgaagtctttgacatggacgagcttgactcggcattcgggggaaagaacccagcgacatttgagtacaacagcttcgcagagcagatgcaggatgacgacaagaagatgggatctttgcacgggtcaaccaatagcttgcttggatcatcttggaaggatgctaat

SEQ ID NO: 81001 - DNA, 290 bp, Zea mays
  Clone ID: LIB3088-032-Q1-K1-B9
gatccgcgtaggaagtttagctgttccttctggcgcagataagtgggcgctgcaaaagggtcgaggcatggagctggtcttttctgcagattttgagcctgatacccgtcttcactgtggctgcaacaccattaccggggcgctgcgtggtggcttctgccttttctttgtttcggcaataatgctcttagtgagctactagcgatggcatgtgcatctatggcaagtaatgagcctgcgataggatgaagattaatctcatgacattagattaatccagaggtctgagg

SEQ ID NO: 81002 - DNA, 306 bp, Zea mays
  Clone ID: LIB3088-032-Q1-K1-C10
cggacgcgtgggtagaaaacgaagatatttgcgatgatggtgaggatatggaaaatggggacctttgtctgaaatcaaaacctacgaagatgatgggaccagaactgttgtcaccaccagtgaaattactcctgaagaagatgacattgtcccgaaaactgtcggccccgtggcgacgagccttaccagcaagaatcctagctcttttgccaagaagaacagcatgttatgtgtgaagaggaagccaccgaagagaacgttcaagagcaaggctagagcgaaaaggggtgacaagaagcgggttgc

SEQ ID NO: 81003 - DNA, 422 bp, Zea mays
  Clone ID: LIB3088-032-Q1-K1-C11
cccacgcgtccgggccttcggaagcgtgataagcacccctaagtgcagctgaaagacggcgcgacagttgtattttcattcagcacaagcggcagctgagcatgctcaatgatgtctaatagcagacgacttgtcctgacacctgagtccaatgtcatcttcatgcagcgaacgttttgctcatgagttaggctatgaggtccttcagctgcgtaacattatgttacttggtctggttgtatcacttattattgcatgtgcacctcttttttccctccttcggaccttgcctcctagtcatcttcagattttaagctaggattatcccttatttacagttgagttattattagaatctattgtgcctgaaaggatcaatctgaactatcaatctgaacgagaggggtgaattagttttttct

SEQ ID NO: 81004 - DNA, 318 bp, Zea mays
  Clone ID: LIB3088-032-Q1-K1-C12
cccacgcgtccgcccacgcgtccgcggactcgtgggcgagggcatgaacggcaaggaggtggacggccgcaacatcaccgtcaacgaggcccagtcccgcggcggccgtggaggcggcggcggcggcgggtacggtggtggccgtggaggcggcggctacggcggtggcgggcgccgtgatggcggcggcggctacggcggtggcggcggctacggtggtggcggcggcggctacggtggtggtggcggcggctacggcggtggcaaccgtggcggcggctacggcaacttcgacgggaactggaggaactgagcggt

SEQ ID NO: 81005 - DNA, 60 bp, Zea mays
  Clone ID: LIB3088-032-Q1-K1-C2
tgtttctggtgggattcaagttcaaccctgggattattgtgaaaaaaaaaaacactagag

SEQ ID NO: 81006 - DNA, 269 bp, Zea mays
  Clone ID: LIB3088-032-Q1-K1-C3
cccacgcgtccgaccggtagcccaaactctggattatagtgacgccagtcctggatttggtctcgagattcattgaagttaaaaagccctcatgtatatggctcactatttatatacatgtaatattggattcccgtgttcagtgtccttttgtatcaatttggctgcatagtgtcttgtggcacttcaaaggacatagattgttgacgggcaaccaaacctcaagaaagtatcttgtattgtttcttgtctcgtgtggtttgttcact

SEQ ID NO: 81007 - DNA, 453 bp, Zea mays
  Clone ID: LIB3088-032-Q1-K1-C4
cccacgcgtccgcccacgcgtccgagaggggggaggcggctctggcgaggctcaagacgtacgagggcgtcccgccgccgtacgacaagaccaagcgtatggtcatccctgacgctcttaaggttctgaggctacagcctggacacaagtactgcctcctcggcgagctctctaaggaggtcgggtggaactaccatgacaccatcagggaacttgaggagaagaggaaggagaaggccaaggttgcctacgagaggaagaagcaattggccaagctgcgtgtcaaggccgagaaggcagccgaggagaagttggggtctcagttggagattcttgcccctatcaagtactgaggagctgtgctttgtcatcagttttggggaacatctagtctttgttttaagtgttcggtaacagtttgtgacagtataatctggtaaaccgtgttatttt

SEQ ID NO: 81008 - DNA, 384 bp, Zea mays
  Clone ID: LIB3088-032-Q1-K1-A8
cccacgcgtccgccctaggcagttcaaggtgccggactggttcctcaacaggaagaaggattacaaggacggcaggttctcgcaggtcgtctccaacgcccttgatatgaagctcagggacgaccttgagaggctcacgaagatcaggaaccaccgtggactgcgtcactactggggcctacgtgtccgtggccagcacaccaagactactggtaggcctggaaagaccgatggtgtcttcaagaagcgatgagctctatatcaccctgagaaatcttggccgcactaccgtgttggaacgtgtgcaaacaggttctgatgaaaggtttctgtctaggcagtttaatgaaatggtgttttgatgtaggacaatctttcggatat

SEQ ID NO: 81009 - DNA, 436 bp, Zea mays
  Clone ID: LIB3088-032-Q1-K1-C5
aaaagaggctactacatcaaggagcagttcaaccactcatttgatggcatagtccatttgatgaggtcttagatgcaactgaacccactccaaggggtttgctcaggaacattgacttgaatttagatccaactgatgaagaagatgagattacagtgccaccccaagcccagtcgatccagcgattagttccgttgcagccactgcgggaccatctgttgcactttctgggtgcttgggaactgcctgacatgaacaatatggagatgggccctgtccagtttgctttgtaaaaaaaaatacagattggagagaatgggtattatgacaatcaagactagctctgcccttatagctttcaaagtggataagtaggatagcatgacaagtgtaggttcatcttaactctttagagattctcatgtatcatgtgtat

SEQ ID NO: 81010 - DNA, 184 bp, Zea mays
  Clone ID: LIB3088-031-Q1-K1-H1
cacgaattcactgctggttagtaacagagaattctccggttaatgtctgctcttggcattctgatgtgttcttggcgtatgaacaacttagatcgttgacgattttccggcaagctggtgcatgatttttgctcgatcatgttcttactcaatgctgagtgcaactcagatacgctgcgtcttt

SEQ ID NO: 81011 - DNA, 348 bp, Zea mays
  Clone ID: LIB3088-031-Q1-K1-H10
cactgtccgtccggtgtctacgattatactagacatgctcagaactcttctaggaataaggaattctacatgctggccatgggcatgcataactattgcagattcatgtacatcttacacaactacattaaccactcgagctatggatcaaattcatgcgttatctctacccgtgtgaatgctacattaactcaacatttgtgctatgtgtaataatgttgtgacatgtcatattctacggctgtactacaatcaatagatgtgatggctgcccaagtctactgatctggcagtattgtgattttaatagccgcccgtactatgaatccttgattacagacttaacca

SEQ ID NO: 81012 - DNA, 446 bp, Zea mays
  unsure at all n locations
  Clone ID: LIB3088-031-Q1-K1-H11
cgtggatattaggaaggatctgtacggcaacatcgtcctctccggtggcaccacgcatgttgcctgggatcgctgacaggatgagcaaggagatcactgccctggctcccagcagcatgaagatcaaggtggtcgctcctccagagaggaagtacagtgtctggatcggaggatccatcctggcatccctcagcaccttccagcagatgtggatcgccaaggccgagtacgacgagtccggcccatccatcgtccacaggaaatgcttctaattctttgggcccgagaaatgcaagccgtgggggagccgttaccgncgncagcctctcctgcccccgttttcgttgccgtttcttcattagcgcgaacaaagttttgtgccggtctatcgggcgccggtttcctgccctattcaataagactgcaataactgtcgctacctatgc

SEQ ID NO: 81013 - DNA, 295 bp, Zea mays
  Clone ID: LIB3088-031-Q1-K1-H12
gatgatccgaatggtcgacatattcgtactaatcttggtcagcatgactcgtgcaatatggattcaaatgtgcatgtcgttgactcaactttacagatccgaggaatgcatactcttatccgcgattgggtcatctccacacctgactttgtatgatattcagatctattgatccattcggcagtggctcatggtcttggacattgtgccatttacagaaaaacatgttattaccccaacaggatcctgtaatatgggagttgacttgcgtatgaagctctattgaatctctatt

SEQ ID NO: 81014 - DNA, 339 bp, Zea mays
  Clone ID: LIB3088-031-Q1-K1-H2
gcgcggacgcgtgggtggaaggtgaggatggaggccaaggccgagggcacgaacggacggctcgcgggcgagcgccgaggtgctcgaggtggccgtggacgtgaccgtggtctagttcgtgcacgacgccggggacgcgctggactttaacaagttctgcgccgtcgacgtccgcccggggcttacggagatcgtctgggcgtggcagggcgacagcctcggcgacgacgtcggcaccgcgtgaacaagcgtccccgtctgtcacgtggaagttgtagcaactttacgtaggagttaaacacggctgtactggcaccagctttttatagcatgtaaagt

SEQ ID NO: 81015 - DNA, 71 bp, Zea mays
  Clone ID: LIB3088-031-Q1-K1-H3
atccgggactctgggcggacgcgtggggttttgattgaaaaaaaataagatatattttatgataggatagg

SEQ ID NO: 81016 - DNA, 375 bp, Zea mays
  Clone ID: LIB3088-031-Q1-K1-H4
accacgcgttcgagcgaatccctcgcatcgcattcgcaggctttgctgcatcacaccaccgcgaaacgccagcagccgcatcgatggcgcccaaggcggagaagaagccggctgcgaagaatccagcggaggaggagcccgctgtcgcgaaggccccggaggggaagaagcccaaggccgataagcgccttccggcggtcaagtcgtgcggcaaagaaggcggcgacaagaagggtgagaagaaggcgaagaagtcggtggagacctacaagatctacatcttcaaggtgctgaagcaggtccaccgcgacatcggcatctcttgcaaggccatgtgcatcatgaactgcttcatgaacgacatcttcgagaagc

SEQ ID NO: 81017 - DNA, 385 bp, Zea mays
  Clone ID: LIB3088-031-Q1-K1-H6
ctcgtcaacttcactcacctcatgcccacccgctacaccctcgacgtcgatttcaaggatgtcgccaccggtgggcccgacgcactctctacccacgacaagaaggtcgccgcctgcaagacggccaaagcgcgccttgaggagaggttcaagaccggcaagaacaggtggttctttaccaagctccgcttctagatgctcggccctccgaataggcctgctttagctggcgaattggtggatcggacacacttcatctttggtttcggattaccatgaatatttcggggttaatcctggggcttttagagataaatttgctaagaattgccggtggtggggtacatggtttcgtgaaaaggctgggttaaaatttggtctggtt

SEQ ID NO: 81018 - DNA, 335 bp, Zea mays
  Clone ID: LIB3088-031-Q1-K1-H8
tcgcgaggatggcagcagtgacgaggaaaacgatgacgatgagtaaacactgtctccaagggcacgaggtatcaaatcaagtgttaggtccccaattagcttactgttttgctgcctttaaatgttaagttgtttcaaacaggtgtttatgaaggggatctattagtttcgcgatgtctgtagtttagtgcattatcaaagaaaaagccaaatgctgctagctgttctgttgcttatcttttgctaaccacttgtgtcacaactttctgtacctgcttcattgactaatctagtgactagttagttattggatcaatatttggtcttggttttat

SEQ ID NO: 81019 - DNA, 367 bp, Zea mays
  Clone ID: LIB3088-031-Q1-K1-H9
ggctgccggtccgacagcaatcaatttgttcgtcaggctggtaattcttcatggcttacggtatactacaatgaggtccaatgggtgcgcacgtcatattgatggatggacatgtggaatatcgtctgagccgacctcttctactgatcagatgcatgctaggctctcgcctctgatgctccatcttcacgatgatgaactaagtgctccgcctggcctgctcgaacacattccagcttcttgcgacattgatggatgtagagggcttgcttgagctactgagcaagcagtattctgcttctgatcggccttctgactatcaggacttcattagagacttcacaagacaactctttcggatgtcttc

SEQ ID NO: 81020 - DNA, 315 bp, Zea mays
  Clone ID: LIB3088-032-Q1-K1-A10
gcgccatggttttatgaatggtgcatcttgctttggatctggggaattaccagtagttggggcctagtattagcgcgggttttgtcgtgctggtgttagcctggttggtgtggtagcgttttgcttggttgttttggaattggaagtggtggtaaggctggcttgcagattaacggatgtaggccgccttttatcacccgtcaattaagcatttgtggggtctcatggtgatagtctctttcagatgagatgttttgcgtgttacctaagtgtgtaggttgtaatgagcccttgtattttgtttttatgcatact

SEQ ID NO: 81021 - DNA, 376 bp, Zea mays
  Clone ID: LIB3088-032-Q1-K1-A11
gtttagtgaggtgaggccatggcgaggaggagcaagcataccgaccatgccgtattcgcggaccgtatttatacacacgacaccgtacattacactcgcgtgatagtaatggttatactgcaaggggaaggtaaggatggcatttaagtgcagagcggagagggtgggtgcctgggtggtctccggccatcagtgcggcggcaggaccggcagctagctagctgcgccggcgcggcacacacttcgaggccaattcaattcaactgtttcaattcatgtaactggcactctggcagcgggtgtttgctgctgcttgctgtgtttttttgaagacgtgaacatgaaatacaaaactgagcttgttttgtccatggct

SEQ ID NO: 81022 - DNA, 392 bp, Zea mays
  Clone ID: LIB3088-032-Q1-K1-A3
cagagattgagataaaaacagcacctgctgacttccgcttccctacaacaaaccaaacaaggcattggtttactcgctatgtcgagtaccacaggtgtttgaatgccaaaggggatgatgctggtgtttgcgaaaaatttgccaagtactacaggtccctttgccctggagaatgggttgagaaatggaacgagcagagggagaacggtacgtttccaggacctctctgaatgtaccgtccgagaccttcaattggaccagtcaacaagttggccatgcagtcctactgttccattctgcattcctacttaccgaatcgtaaatgccttttggtccttgctctttaaccaattaccacaaaactgttagtgatgcctctcgtacgcagctct

SEQ ID NO: 81023 - DNA, 398 bp, Zea mays
  Clone ID: LIB3088-032-Q1-K1-A4
cgacaagaagaagatcgaggacgccatcgacgcggccatcagctggctggacgccaaccagctcgccgaggcggacgagttcgatgacaagatgaaggagctggagagcctttgcaaccccatcatcgccaagatgtaccagggcgcgggtgccgacatgggtggcgccggcggcatggacgaggacgctccggctggaagcggtggccctggccccaagatcgaggaggtggactaagcggattgtgtcagtctcgtgtgtctgctgcagtggctggctggcccagtcgctgctcgatttatcgtcgtcgtcgcggtgtatccgcgttagaaccttttgttggtgaacaatattatcgtggcacgcgttttaagtaatacggtattctggttcggtt

SEQ ID NO: 81024 - DNA, 441 bp, Zea mays
  unsure at all n locations
  Clone ID: LIB3088-032-Q1-K1-A5
gaaaaaagaacagaaggagagggagctacgtgcccaaataattgctgaagccgaagaattcaagaaagccttttttgagaagaggatacagaactgtgcgtcaaacatggtgaacaacagagagagggagaagatttttgtagccagccaggagaaattccacgccggcgcagacaagcagtactggaaatcgatttcggatctcatcccacatgaaatagccaccatcgagaagcgggggaagaaagacaaggacaagaagccatccatcacagttgtccagggccccaagcctggcaagcccaccgacctctcccggatgcgccatatcttggtgaagctgaagcatgctccgncgncacatatgttgcagccttcaccaccagcacctgctgctaaagagggcacaaaggatggcagcgccaaaagtggtggaaagga

SEQ ID NO: 81025 - DNA, 296 bp, Zea mays
  Clone ID: LIB3088-032-Q1-K1-A7
cccacgcgtccgtccacgcgttcgtccactcgtccgcaagtgcgcttgtcggccagtgccgtgtaaatttctgagagttggtcttgtgttattaccaggttttgttcgtttctttcgttttggagagagtggtgctacctacctgcactgctacactagactaatctgtgtgaatggaatactactgtactttgtctttcttctaaaaaaaaaaaattagactcttactgattctgtaataccgtactgattctattagcattattccgtcgtaaactgttaatttaaacattttt

SEQ ID NO: 81026 - DNA, 371 bp, Zea mays
  Clone ID: LIB3088-031-Q1-K1-G9
atgcgtcccgtactactgaggccgcatgctggcctagtacgacgtacaagtatacctgggcatctggagactaccaatgcgacatctatagcatacatgctcattcaccccacgaatacctagacttacaaatataacactggctaaaactcgaagctgcactattgcagtctcgccttaccgatacgtgctgaccataatatcatgtgtgtaacaagggacacaatagtggcacgtctaaagcattgcgcgaacaggctcacactgccaccactacctttacagttccattatgagcagccattactagtggatctcctagtttgacaggttcgcgaacaaaaaatctgcatccttctcaaaacacacac

SEQ ID NO: 81027 - DNA, 288 bp, Zea mays
  Clone ID: LIB3088-031-Q1-K1-F10
ttcccgaattgacccacgcatgcactctaacgtccatacactctactccgcagccttgccgttctcagaacttgctattgtcttcggcactgggttaatcttaatggggtcacgggttctaatctgattccaattccaatgctcaaggaccttacagccaaattcatatagttaaagcatggcgtacatgatctgatctttcaaccactaaactaattcatacactcggtttccagacacgttcttatcaaacagggtgatattcctataaatgtgaatatcatactc

SEQ ID NO: 81028 - DNA, 447 bp, Zea mays
  Clone ID: LIB3088-031-Q1-K1-F12
cccacgcgtccggcgggaagggtctgggcaagggcggcgccaagcgccaccgcgaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccagggccgcaccctctacggtttcggcggttaggtcgcccctctcccggtggcgaattacgtggtggcggtggcggtcgtgttgtgttcttggtctagttagtctgtgttgtctttatcggtgctgttttctgtggtggttgtactgcatcgttctaatttctagtccatgtgct

SEQ ID NO: 81029 - DNA, 458 bp, Zea mays
  Clone ID: LIB3088-031-Q1-K1-F2
cgctcctcacctcgcggcgactcttgccaagcattcctccgcgaaaaacgcatccgctccaaggggagttgatcgagaagcgttggtggacatgggtcagatccagtactccgagaagtacttcgacgacacctacgagtacaggcacgtcgtcctcccgccagaggtcgccaagctccttcccaagaaccgcctcctctccgagaacgagtggcgcgcgatcggagtgcagcagagccgcgggtgggtgcactacgcgatccaccgcccggagccgcacatcatgctgttccgccgtccgatcaactaccagcagcagcaggaggcggctgccgcgcagatgctggccaagtgagcccctggtggccagggcggcgaccaggaacgtttaaaaccctaaccccctttccatttctaaaaggggcgtcgctgttctgttgatcaattcctctatgctg

SEQ ID NO: 81030 - DNA, 271 bp, Zea mays
  Clone ID: LIB3088-031-Q1-K1-F5
gtgatctatgccgtcctgagcaactgcgtccaacgccgggtcgccgtcaaacttgctcggctgccggtgtccaaagctggagaacaagacgccaccgccattctagggaggatcgttgctcgcagcaagctgttcgacgttggctgcgtgctcttctacaaagagggtgacaatggagtgaacatgcgaccgggggggctgattcactcggcgagggaagcacgtcgccgtgccgctgcacatgccgctgacgattgatcttgacctgcat

SEQ ID NO: 81031 - DNA, 146 bp, Zea mays
  Clone ID: LIB3088-031-Q1-K1-F6
tcatcctcggacacgtgggaaaaaaaaaaactaccataacaataaacaaaatactaaatatgaaaaggggaaatcctaaaaaaggagaaagacaaacaaataccaccaaaactacaaagcaaaactctcacaacatccaccaattc

SEQ ID NO: 81032 - DNA, 372 bp, Zea mays
  Clone ID: LIB3088-031-Q1-K1-F7
acgcggactcgtgggtgaaagaaccagtaggaataatcaaatttgaggtgttcgactggtacgggtacatgtactacgacaagatgggccaggctttcctggacctgcatcctgaaacggcggcaaccaagctgctgaaggcgctgcggctcacagctggttagaccaaccttgcttaagtgaacccggacgccgacaactgtctgttctaagatagcttcatgacttacgccaactgggaggtcgcgatagatgctacgctgcggctgcgtgaggtcgaggttccgccagctgttcgtcactataaagttgattgaacctgacagcgccaattcttgtaaagctagctgattactagctagctatgcattt

SEQ ID NO: 81033 - DNA, 274 bp, Zea mays
  Clone ID: LIB3088-031-Q1-K1-F8
acgtctcgtaacagcgtagaacttctttcaactgttctttcctgttctcctgatcaggatgcggtacatgatgacttgacaaccactcttgtgctacaatgcttccaatctcagctcactatccagatgattattgagaccgttggagacaatgaacctgtgctctttgaggcctggtgcgttaacgatgagatccagaaattgttatttgagcactacgatatgaatgtgcctagggcctccgatcatgcagaacatgtaccagttattatac

SEQ ID NO: 81034 - DNA, 418 bp, Zea mays
  Clone ID: LIB3088-031-Q1-K1-F9
tcgggcgcggtgtgcatgaggcgaaggtggtggttagcgtgacggttgagggcagcgtcagcggggtgaatgccatggtcaggctgggcgccagcgtctgggaggccattgctgccgtggtcgagaggtacgccagggaggggagaagcccgcgcctggatccggccgcagcatagagcttccaacttcaccactcccacttcagccttgagagtctgaacaagaaggacagaatcggagacgtgggaggtaggaacttctacctgcacaagaacgattcaagcaacgacgggctctacctacagggccaggatgagcccggtgcagatccaagtggtggtgacatcagtcggcactcctcctcatgagtaggacaagcatctggtggcgctacaagtcagtaccaggtccttaccat

SEQ ID NO: 81035 - DNA, 241 bp, Zea mays
  Clone ID: LIB3088-031-Q1-K1-G1
gcgcccacgcgtccgcggacgcgtgggactggacctatcggcaaggagtgtgctgacctttggcctaggatcgccagtgcagcaaatgccatcgtttgagagcttgttggaatgtgtttagacttgagtatgatcatctcaattgtgtgttgcaggtgttgtaagggtgctattggacttgatggctccttttatgtttggtcactcaattctgtagtgaacagaaatttctggttgcctc

SEQ ID NO: 81036 - DNA, 161 bp, Zea mays
  Clone ID: LIB3088-031-Q1-K1-G10
cccacgcgttcgcccacgcgtccgctggaaaatagcttccgtgacgttgtaatggattgtgagaggggcgtttggtatgggtcaatcccaaggggaccctaacttcagagatgtaaagtagttttgggagctgcagtacaaatttaattttcgaattttgg

SEQ ID NO: 81037 - DNA, 410 bp, Zea mays
  Clone ID: LIB3088-031-Q1-K1-G12
gtcttgccctccaagatctacatcttcaaggtcctgaatcaggtgcaccccggggtcggcgtctactccaaggccgtgtccgtcatgaactccttcatcaacgacatcttcgagaagctcgccgcggaggccgccaagctcgcccggtacaacaagaagcccaccatcaccttccgcgagatccagacctccgtccgcctcgtcctccccggcgagctcgccaagcacgccgtcttggagggtaccaaggccgtcaccaagttcacctcgtcttagcccccttgtagtaggcgtcgttgttgtctgcttctcaagcaagcactgtgatgtgccgcttttcatggtagtagtgtggtgtggctggtgtgtgtaagtggtgcaatggcttttggccgtgttatgaatttagt

SEQ ID NO: 81038 - DNA, 474 bp, Zea mays
  Clone ID: LIB3088-031-Q1-K1-G2
tggggatctgcctaaagtgggaaatggtgccagcaaactcacgcttgagtatggaggtgagcccgtgtcttggttccagaagaagataagagggaatatgatggtactgaatgatcacatatctaaggagatgaatgagctgaacctaataaggtgccaacacattccgaaacggccgggttgtgattggcatgacctaccggacgagaaggttaagctgtcaaatgggcagatggctgacctgataccttggtgcctgcccaacacagccaagaggcacaatcagtggaaaggactgtacgggaggctggactgggaaggcaacttccccacatccgtcactgatccccagccaatgggcaaggtcgggatgtgcttccaccctgatcaagacaagatcatcacagtccgggaatgtgctcggtcacagggctttcctgacagctatgaatttgcgggcaacatccagaacaa

SEQ ID NO: 81039 - DNA, 262 bp, Zea mays
  Clone ID: LIB3088-031-Q1-K1-G3
actcatgcgtacgaagaaggaggagaggggacgatgctacaatcctgcctagccttcatcgggttactgggctcgagcggctcgccgaggtgagcgccatgtagctcgccctcagctctcgctctatgctgctctaacttactgtagagggggactagaagttcgagcgcctttatttgtgcttgtacggaagattgcttgcttgcgtgcttgatgatgtatgctcctagcgatgtggtgactgggcgagggacccccgatc

SEQ ID NO: 81040 - DNA, 450 bp, Zea mays
  Clone ID: LIB3088-031-Q1-K1-E9
acgagtctccctagcaatctctagcatcagatcctcgtgcaaagcaaagcgctagcgtatctagtgtccccatggcccggacgaagcatacagcgatgaagtccactggcggcaaggcgcctaggaagcagctggccacgaaggcagctcgcaagtctgccccggctaccgactgagtgaagaagccccaccgttttcgccccggcaccgtatcgctacgggagatccgcaagtaccagaagagcactgagctgctgatccgcaagctgccgttccagcacctggtgcgtgagatcgcccatgattccaagaccgaccttcgctttcagagcttcggcgtcgcctctctgcatgacgcatgctatgcctaccttgtccatctcttcgaggacaccaacacttgcgccattcacgccaagcccgttaccatcatgcccaaagacattcatc

SEQ ID NO: 81041 - DNA, 392 bp, Zea mays
  Clone ID: LIB3088-031-Q1-K1-G7
gaagaagagggaggagaggggacggtccgcgaatcctgcctagccttcgccgccttcctgcgctcgagcggctcgccgaggtgagcgccgggagctcgccctcagctctcgctctatgctgctctaacttactggagagggggactagaagttcgagcgcctttttttggacttgtacggaagattgcttgcttgcttgcttgttgttgttgctcctagcgatttggtgactgcgcgagggacccccgatcacgcggtacgtagaggaggttttgctccgcgtgatcgttagtttggagcctggaagagccaatctcagactacgggtctcgcggcttgctctggggccgttggagtgggtgggatatcgggtgcgtcttgtgggtgcatgc

SEQ ID NO: 81042 - DNA, 362 bp, Zea mays
  Clone ID: LIB3088-031-Q1-K1-G8
tcccaactaacggaggccgggtccgagacgagtactgaggacaagaaaaccaagtgatggccaatcttttgatcatccaagtatagcatacatctcagcaacacctgccttcccagccggcgtgaaatttcttttgctgaaactggatgctggactcttgcggtcttgccttacctagacgtgctgaccataagataaggtgtgtaacaagggacacgatagtgttttgtctagagcagcgggcgaacaggcgcacactgtcacaattacgtttccagttcgtcttttagcagcctttactagttgatatgcttgttcgattggtatgtgtacaaattttgggcatgtttcttaaaacacac

SEQ ID NO: 81043 - DNA, 363 bp, Zea mays
  Clone ID: LIB3088-025-Q1-K1-H12
gcgtccagatccccgactggatctcctaggggtggacgccgagaccgtgatgagaggggatcaaggagtcttagctacagcaggagcgcaagccctaggcgttctgtgtcacctgcaaaggaaaaggagcgcagccgcacacctgatggcagtaggagccccagcccaagggacaaggtgagcccaccaccaaaggataatggtgcccacaatggctcggaccgtgaagacagccctgggggcaaggagatgagcaagaggagtcggagcccgtctgatggctaccgtagccctgtgggcaatgggcgcagcccgagccgtagcccaagccccaaggtcaacaatggtgatgacccaagcccc

SEQ ID NO: 81044 - DNA, 354 bp, Zea mays
  Clone ID: LIB3088-025-Q1-K1-H2
tcgtgagcggacgcctttttgccattaacacccccaagttcgacgtggagcaaaagtagggcttctacacctgggtggagatctactgcgcccccaagcctgcgctgctgctgtccaccgttagcacgctctacactctatggctcgacatccatcagtgcatcttcagcttcttcaaccacttccgcatgcacacctactgctcctagatgcatatggaaatgatcagcgccgactcgataaagcaagagctgttcaagaacgcttgctatagcggatgctgcttgtagaggggcatgtcatcatcgcatgggaggaacaataagaagaggcagcaataaattaatcttaaac

SEQ ID NO: 81045 - DNA, 192 bp, Zea mays
  Clone ID: LIB3088-025-Q1-K1-H3
atgcgctctgctctgaggactggaggtagtgctggtaagctttctttgcttctggaacaacatccggtaatgtgtaactttacgtgctagcaactacttgctgtttgatctcagacactttaatgatccacttcctgatatactctacattctataacctttcggtctctcccttaacattatgctagccac

SEQ ID NO: 81046 - DNA, 457 bp, Zea mays
  unsure at all n locations
  Clone ID: LIB3088-025-Q1-K1-H4
gcgaatttatccacagaaaggtgatatctgggctgtttatcggaattggtcctctgactgggaggaagatgctccagataatgtgctccatgcctacaatgtggttgaggtactggatgcctatgatgaagtccatggcatctccataattcccttagtcaaggttactggatttcgaacagtatttcagcgccatcaggatccaaatgctaccatgaagattcctaaagaagagatgtttcggttttcacacctagtgcctttttacaggatgtcaggcgaagaagctgcaaatgtccccaaagatagttatgagcttgatccagctgctatttctaaagaactgcttcaggggatcacggaagcagtggagccaaatggaacctaaggcagttgatgatgcctgcctttggtaacctgccatttttgaagtaatcgagcanaaagatattaacac

SEQ ID NO: 81047 - DNA, 223 bp, Zea mays
  Clone ID: LIB3088-025-Q1-K1-H5
catacactatattataattactagaataactttattaccttcaaataactacatcttgaaagggcttaaacttaatgctcgcgaacatcatcatctcctctatatccatttccatcattaacttcttcatcaactacatcttctaaaaactttccttctactccttcaaactctctcttttcaacaagaaccctaccatcacctccctctagatccatacctc

SEQ ID NO: 81048 - DNA, 437 bp, Zea mays
  Clone ID: LIB3088-025-Q1-K1-H6
gcgcccacgcgtccgcccagttcttcatctgcaccgtcgcgaccccttggctcgacggcaagcgcgtcgtcttcggccaggtcgtcgagggcatggacgtcgtcaaggccatcgagaaggtgggcacccgcaacggctccacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattcccgtttaa

SEQ ID NO: 81049 - DNA, 447 bp, Zea mays
  Clone ID: LIB3088-025-Q1-K1-H7
cggacgcgtgggagaagggcaagaagagcgtggagacctacaagatctacatcttcaaggggctgaagcaggtgcacccggacatcggcatctcctctaaggccatgtccatcatgaactccttcatcaacgacatcttcgagaagctcgccgccgaggccgccaagctcgcgcggtacaacaagaagcccaccatcacctcccgtgagatccagacctccgtgcgcctcgtcctccccggggagctcgccaagcacgccgtctccgagggcaccaaggccgtcaccaagttcacctcgtcctaagctgcgtggcctccgcttgcaggcttccctcgtatgttcgcgtgtcttgctgtaattaggtgctgctgtgtctggtcttctttcgtagcaactgttatctgatggaacagtaacaatgcttattgaaatcagctagttgctt

SEQ ID NO: 81050 - DNA, 445 bp, Zea mays
  Clone ID: LIB3088-025-Q1-K1-H8
cggacgcgtgggcggacgcgtgggcggcgacgggaacgggaggcggcgcggccggagatgcgaagcgatggcgttcacgatgcgggcagtgaaggtgcctccgaactcggcctcgctggaggaggcccggcaccgcgtcttcgatttcttcaagcaggcatgccgctctatccccaccgtcatggagatctacaacctcgacgacgttgtcacgccctctcagctccgctcgaccatcgctaaggagatccgtaaaaaccagaacgtcaccaaccccaaggtggttgatatgcttctgttcaacgcgactgaggagctgaacaacatagtcgaacatgcaaagcagcgccatcatgtggatgggcagtatgtgatcggccaaaatggcctggtgcattaactggggtcgaaggatctagggaactctgactttctgaagaaattc

SEQ ID NO: 81051 - DNA, 322 bp, Zea mays
  Clone ID: LIB3088-026-Q1-K1-A10
gacgaggcagccgtcgtcgtagctccacagcggcatgtcctggtccgccggggcggcggcgttgctctgcacggcgtcggcgctgaacaggctgtccagcgactcgtacgcgccggcgtcgaagaaggcgaactggtcgccgaagaggagcgagtcgaacagcgcgtccgactcggagtcggaggcccggggcgacgcctcgtccgcggcgctctccggccgcgcctcgaagtcgaaggccgggcgcggcgcgggggcctcgtcgtacgccgtcgacacgccctgccacgagaagtccgggagcgcgtctgatcctgagcac

SEQ ID NO: 81052 - DNA, 365 bp, Zea mays
  Clone ID: LIB3088-026-Q1-K1-A11
agccgaagttcagaaactcaaggaacaatacgaagaattgcagaagaagcaggaagaagtaatggagatgcagaaaaaccaggtcgtggaagtgatcagcaatccatacgcacaaaagaaacggtgcctgcggagaacattgacaggtccctggtaaccgagctgttgacgaccgaccgggcttgacaggatatttaacattatggcacctgtacatatataccttgaggatttggagaacccgagtttccggtgtatattagcgaccaacagagtgtgagtgtaccttcgcttgacttaaaaaaaaaaaaattttttttttattttttttatttatttttatatttatatatttttttttaatt

SEQ ID NO: 81053 - DNA, 336 bp, Zea mays
  Clone ID: LIB3088-026-Q1-K1-A12
gagaaaactgcaatgtgtgtaacagtgcttcagatgctcatgctaggcagcggttattggcttgttactaggcctggaaagggcctgcattgtccacagcttgttctcactttgaccagattcctacatattgcatcattctatgatacgattggcgtctatgacagtgctgaccttgttcaaatctatgcagttactagccgaatcttctaataggcggttgtagattttgcaggcgacgaactactgcatattgcgacaactgtaaaagttacacatgatcatctcgatcgcgctctagaggacaccaactcatgagttcttattaacttgata

SEQ ID NO: 81054 - DNA, 333 bp, Zea mays
  Clone ID: LIB3088-026-Q1-K1-A2
tgggtggaaatagctaacactcactcagagcgatccacttcaccgcgagcttaaatctccgacaggcgcttcttctggagatgggtttgatgttatgactctagccacagatcagcctgctggaccagtttcagcaacgcctaaggtacctaatgccagagatgatgataagttcaatgatggcatgtacgaagacttgtgtgtagatgatgctgaccttacattcgaggattatgaagagctatttggtacctctcacattcgaacagaggaactctttgatgacgctggaattgactgttacttcgaattgaaagagacaccaccttttta

SEQ ID NO: 81055 - DNA, 283 bp, Zea mays
  Clone ID: LIB3088-026-Q1-K1-A9
gcgcggacacgtgagccgactacatgacaagtcatgctagttcggaagagaaaagcaggaaggtctttgtcggtagagccaaaggatggtctctgatgaacttgaaccaaagctggaggatgcttataacggggagacgtctacctgataagtaaaagttatcagcatcttgatgccaactgccccctatcatggtttttattggccctttgcttgattctcatttccctttggagccagtttcttctgttattgcgaggtcacacaagccttatttgtagta

SEQ ID NO: 81056 - DNA, 421 bp, Zea mays
  unsure at all n locations
  Clone ID: LIB3088-026-Q1-K1-B1
cacgcgtccgcccacgcgtccggcgacggcttcttcatagaggaggaggaggttgaagaagacgtgctgactgacaactcgtcgatcggggcgccgtctccctcgggatcgtcgatcggtgagaactcgtcgtcggaggccggcggggacgacggggaggaggaggtcgagagcaagctcaaggagggtgatgtgctcggctgcttggacgcgctcgaggactccttgccgatcaagaagggcctctcgagcttctactccggcaagtctaagtcgttcaccagcctcgccgaggccacagcggcggcggcggcggtcaaggaagtgctggccaagccggagaagcccttcaacaagcgccgtcgcatcctggccaactggtccaagagagcctnctgcagctcgctggccacggccacct

SEQ ID NO: 81057 - DNA, 390 bp, Zea mays
  Clone ID: LIB3088-026-Q1-K1-B10
cactcatcttttcgcgtttagaacctctaaaatttcccccactcgccagtcgcagcagcgacctgtagccatggacgccagcggagccggtagcaaggggaagaagggtgcggccgggcgcaaggcaggcggccccaggaagaagtcggtgacgcggtccgtcaaggccgggctgcagttccccgtcggccggatcgggcgctacctgaagaagggccggtacgcgcagcgcgtgggcactggcgcccccgtctacctcgccgccgtcctggagtacctcgccgccgaggttctggagttggcagggaacgcggcgaaagacaacaagaagacgcgcatcatcccgcgccacgtgctcctggcgatccgcaacgactaggaagctcggga

SEQ ID NO: 81058 - DNA, 246 bp, Zea mays
  Clone ID: LIB3088-026-Q1-K1-B12
agagcctgagaacaacgaatatgccccttatgacgtcataggtggtgagggggaagatggggaacttgaaaggaccaagcgtgaacgcaaaacaacaaaatacatgacgaagtacgaacgtgcgctcattctgtgtacacgagccttgcagataagcatgaatgcttcagtcatggttgagcttgagggtgaaactgaccctcttgagattgcaatgaatgagctgagagctcgcaagataccctt

SEQ ID NO: 81059 - DNA, 300 bp, Zea mays
  Clone ID: LIB3088-026-Q1-K1-B2
gcgtccgaagaaacaaacggcgacagcaaacacatataagaagaggaggaagaaagaagacgagcaggctgacaactaagcagatcggggcgccaactaaaaaggggaccgccgatcggagagaacacgtcgacggacgccggcaggcacgacagagaggaggaagacgagagcaagctcaaagaggacgatccgctcggctacaaggacgcgcccgaggacaccttgccgatcaagaacggactctcgagctactacacccgcaagtctaaggcgggcaccagcctcaacgaggccaca

SEQ ID NO: 81060 - DNA, 195 bp, Zea mays
  Clone ID: LIB3088-025-Q1-K1-H11
gaatccaccggatcgaccgacgctaacgaccactcgtacgctgaacatgagttttccctctcaattcacaaacatttctacatgagaacagttgacattggacaattcccgggcgatcctgaacacaaataagctatactcctacaaactaaccaagaccacaaacaacaaaactactctgacatttaccaacac

SEQ ID NO: 81061 - DNA, 168 bp, Zea mays
  Clone ID: LIB3088-025-Q1-K1-F3
gcgggaacgggtgctatattctgttcagcctttgcagttatgtggtgtacctctctgatggtagcactggcatctcacagtgagcgggactttgtaaattgttgtacagaaaacgtacatatgatgatgccgtgttaccctgatattcatgacaccgttgtttaccac

SEQ ID NO: 81062 - DNA, 462 bp, Zea mays
  Clone ID: LIB3088-025-Q1-K1-F4
cccacgcgtccgcggacgcgtgggcgagaagagaccaggccgaaggaaaacaatcctgaagccaaggcatgggtcagcaggaggaatttgaggagcatgctgagaaggcaaagaccttgcctgagagcacgagcaatgagaacaagctgatcctctacgggctctacaagcaagccacggttggagatgtgaataccgatcgtccgggcatattctaccaaaaggacagggccaagtgggatgcctggaaggctgttgaaggcaaatcgaaggatgaggcgatgaatgactacatcaccaaggtgaagcagctccaggaggaggctgccgcctcttaaaagtctcttaatagtgttgccaaacagctatttgtcagatgagctttgtgccatttcctcattagaagtatatcattcgatccattggggatctgtgaaccatgtacctggttatgtaactttt

SEQ ID NO: 81063 - DNA, 127 bp, Zea mays
  Clone ID: LIB3088-025-Q1-K1-F5
aaaaaataaaaaaaaaaaaaaaaaaaaaggaaagtgttaaaaaaaaaaaaagggaaagaaaaaaaaaaaaaaacaaaaaaaaatacaaaataataaaacctaaaaaaaaaaaataaaaaataaaaaa

SEQ ID NO: 81064 - DNA, 404 bp, Zea mays
  Clone ID: LIB3088-025-Q1-K1-F6
ctgggccgtccaccgccacctcttctaccatgacgcgtcggatctccgggacagggtcgagtccaaccgacacgtgggtaagctggacgtggtcgataggctcatcgacgatgcggaggctcagtacaggaacttccagcaccccgatccctacattgttccatgggcaccaggcggcactaaattcacaagaaacccccctccacctcaagggatcgagatcatctacaattatggcaaggaggaccagtaaacaagagtcctgcaagcggggggcagaacttccacagttccaaatcacttcctgtttaatcgagttgttgtacgagaaataagaatggaaattactggactccatccatgcttctcatttgcttgttctgataatcatgtgctcttcatct

SEQ ID NO: 81065 - DNA, 429 bp, Zea mays
  unsure at all n locations
  Clone ID: LIB3088-025-Q1-K1-F7
cgacgtcaaggtgaacggcgccgtccacaaggggatgccgcacaagttctaccacggccggaccggtcgcgtctggaacgtcaccaagcgcgccatcggcgtcgagataaacaagcaggtgaatggtcgcatcatcaggaagcgtatccatgtccgcgtggagcatgtgcagccgtcccgctgcacagaagagttccgcctgaggaaggtgaagaatgatcagctgaaggcggatgcaaaggagcgcggcgaggtcatcagcaccaagaggcagccgttgggtcccaagcctggcttcatggttgaggggactaccatcgagaccgtcactcccatcccgtacgatgtggtcaatgatcttaagggcggatactanngttgttggttggtctttctgtggtactctagtgcgtacaattttgctcacac

SEQ ID NO: 81066 - DNA, 426 bp, Zea mays
  unsure at all n locations
  Clone ID: LIB3088-025-Q1-K1-F8
cccgtcgtcgcaggtgtcgcaggtgttcgagaagtcgctgcagtacgtgaagcgggtcatgcgctacaagaacccggacgccgtgcgccaggtccgcgagacgctgagccgctacggcctcgccgagttcgagctctgcacgctcggcaacctctgccccgacaccatcggcgaggccaccgcgctcgtcccctccctcaagtccggcggcaggttcgtcggcgaccccggggacgagaagatcgagaagatgctcaacgacctctccctcatcaagaagttcgagtagagcgggagccctctcttctcttatcttcttttctcttggagtagcgagcatccagagaggaggggaattcaacatcaagacgatgtactgataaaattttacttgccttacactactnatcgtgaagttcacgtctg

SEQ ID NO: 81067 - DNA, 272 bp, Zea mays
  Clone ID: LIB3088-025-Q1-K1-F9
ttcccgaaccagacccacgcttccgcccacacgtcctctgactcttgttaaaaattataaacccaaacaaacatataaaagataaagtaaaaataaaaacagatcacagcaaaactaaataacacatcaaaaaaaaaaccaataaaacaaaaaaatctataatataaaataaaacctatatcaaaaccctcacaaaaacatcctacaacttacttccaaaaacttttcactaataaacaaaatattacctattcccatcttacactattaaa

SEQ ID NO: 81068 - DNA, 302 bp, Zea mays
  Clone ID: LIB3088-025-Q1-K1-G11
ctcatgaccactagaatgtactcagcactcaccacagcgccatccattgacgagcgtctgaggcttaccaatcagggcgcacggtacaagctctcacacagcatcatcaccgacaagctacacacttcagaccatacactacctgtcatcgaacgcttttactattggaactcaaactgaccttctcatacttaagcttcacttattatcacaacctgccaatcacagctggacaccatcactcgacattttacaacccatcctgaatatgatctccctgaagtcaacgctttggcaatcac

SEQ ID NO: 81069 - DNA, 282 bp, Zea mays
  Clone ID: LIB3088-025-Q1-K1-G12
gcgcgcgagactgtgcgaccgtgagtgcttcttggtcagggtctggatcgtcccgaagtgtccgttgtcgcccgtgtgcgtgtgtgatgggtttctgtcgctttgtagcagtagtagcagccttgcctgttgggctggtagtggtacttccagtgccaggtgccggctgactgtagtgtgactctgaatgctgcatctgttctggggttgaaaaaataaataaaatccaacaaaacgagctcccttcgaagcgcaaaaaaaaaactgaaaaaaactttaaat

SEQ ID NO: 81070 - DNA, 363 bp, Zea mays
  Clone ID: LIB3088-025-Q1-K1-G2
atttccaatcgacccacgcatcactcaaaataacatccttccttccaaaaaaattttacaataaaaaactacaatacataaaacagctaaagttaaaattataacatcatcacggtactccaaatacaattatacaataaacccctactacacttgttcaattatacctcttctcatataccatacactcttaccctccaccattttctactccacaatcttaattaaactgctcaaatcattattactattcccaatcgataccaattcctacccattacataaatttccttttcccacattatattttttcaaaaatttctatctcttacattctttcttcttataaattcatctcacata

SEQ ID NO: 81071 - DNA, 193 bp, Zea mays
  Clone ID: LIB3088-025-Q1-K1-G3
aatttccaattcgaccgacgcgtgactcaacctactgagagcccagtcatttcactctgcaatccttctcagcacaatatccaaggggtcaggccaaaattcaaaccgaagaacgctgtacacatctctcaccgacaacatctttacggtgaccgcacaagatactatagccaactccaggaaattcaccaaa

SEQ ID NO: 81072 - DNA, 396 bp, Zea mays
  unsure at all n locations
  Clone ID: LIB3088-025-Q1-K1-G4
actatcattaccactttcacaacaccgaatatgccctctacagctcaacatcgatcaagagccnaagaagatattcatatcgggtttggcaaactattatccatataacctgccaaagtttctgtccactaaaaacactctcatctcactattgctcgaatccagattctcatagcatgcttctctaacgactaatgcatgcacacttattcctctataatctatatggatatcttcatcaccaactcactaaatctttagcttatcaagaacgctttcttagaatgaatctacttacatagcggcatctcatcatgacatggtaaataagaaaaagaagcatctgttttcatttaacctacagcaacttattgatcatcaacacaagtctcactt

SEQ ID NO: 81073 - DNA, 376 bp, Zea mays
  Clone ID: LIB3088-025-Q1-K1-G5
gaaggtcaaggcttcgtacaagctctcggactccgccaagaaggcatcccccaaggccaaggctaagccggcaaaggccggcgctgccaagaccaccgcccccaagccggccaaggccgccgccgccaagtcaaagaaggcagcggctgccaagccaaagaaggccgctgctgctgggaccaagcgcaaagtgcccgagaagaaggtcgtggcgaagccgaagaagtcccccgccgccaaagccaaggccaagccgaagaccgtgaagtcccctgcctccaagaaggcacggaaggcctccgcatgagatgggttgctttaggtctaagctctgatggtggttggtgtcagttaggtactgtacaaactaagtgtg

SEQ ID NO: 81074 - DNA, 434 bp, Zea mays
  Clone ID: LIB3088-025-Q1-K1-G6
gtttgcattcatggcgattggatggcccttaatcattctcaaatcaggactaggtggatggtttaagttctggttcatgccatggatggtttatcatttttggatgagcacttttacaatggtacatcacacagctcctcatataccattcaagtcatctgaagaatggaatgctgcacaagctcaattaaacggcacagttcattgtaactatcctcaatggatagagatcctttgccatgacataaatgtgcatgtcccacaccatatttctccaagaattccaagctataaccttcgtgctgcttatgattccatcaaacagaactggggcaagtatgtcaatgaagccaactggaattggcgattgatgaagacgatactgacgagatgccatgtgtacgacatggagagatactatgttccgttcgatg

SEQ ID NO: 81075 - DNA, 247 bp, Zea mays
  Clone ID: LIB3088-025-Q1-K1-G7
tcatactaaaaaaaaaaataaaaaaaaaaaaataaaatttaaaaaaaaaaaaaaaaaaaaaaagaaaaagttaaaattaaaaaagggggccgcttatcaaacatccctttttacttaatcctcctttctatcgtatatcatattctatactcatatcccattcaatttatctcaccattttttttacaaccccttctcttttaaacccttctctttacccaacttattctcctttcatcaaattcct

SEQ ID NO: 81076 - DNA, 452 bp, Zea mays
  Clone ID: LIB3088-025-Q1-K1-G8
cccacgcgtccgcggacgcgtgggggccaggaacacccccaagttcgacgtggagcggaagtagggcggcgacacccgggtggagatctactgcgccgccaagccggggctgctgctgtccacggtgagcacgctggacacgctagggctcgacatccagcagtgcgtcgtcagctgcttcaacgacttcggcatgcacgcctcctgctccgagatgcagagggaaatgatcagcgccgacgcgataaagcaggagctgttcaagaacgctggctatggcggaggctgcttgtagaggggcatgtcatcatggcatgggaggaagaagaagaagaggcagcaataaattaatcttaagcagctgtgggagcagcagtagtagtatcagttcaggtccagtagcggaaaaggcaggcagggcaaagaattgggaggcctttttgcaatccatc

SEQ ID NO: 81077 - DNA, 286 bp, Zea mays
  Clone ID: LIB3088-025-Q1-K1-G9
attcccttctcgacccactcttcctcaataaatatcatcttttttccctttaaaatataaataaaaaaaaaaaaaaaaaaagaataagttaaatttaaaaaaaaaaaaatgccataaaaaaaaaaaaaataacatattcttacaaataatattttccaccttttattttttaaaattactaattcttcttactttctttttatttttcaactctttcttaccattcttctcctttttaattttattttttatctcattatattccattttccttttttttttcttt

SEQ ID NO: 81078 - DNA, 398 bp, Zea mays
  Clone ID: LIB3088-025-Q1-K1-H10
cggtcttgaatctgccggtcgccgacgcgtacgcccacgcgtccgccaaaccctagctcccgatctcgatggcgaaccctcgcgtctgcttcgggatgaccgtcggcggcgcccgggctggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacaccgtccccggtgtgctctccatggccaacgcc

SEQ ID NO: 81079 - DNA, 237 bp, Zea mays
  Clone ID: LIB3088-025-Q1-K1-F2
gctacacttagatctccaaacactcgtaactatcctactatgaggttacatctgtccccaaaagcatttgtggtcatagaagctggccttggtttgtcagacctacaatcttacttacatacaattccttcttttaaatatcttatgaattgctgctacttaaaaaaatcatacttttttaacaactcattaatttaatcaacaaaactctctacaacttaaaatatctatatcatt

SEQ ID NO: 81080 - DNA, 408 bp, Zea mays
  Clone ID: LIB3088-025-Q1-K1-D6
acccctgacgcgtttgcacgagctgactgaattttttggtaaaatagacattaaatcagcttcagatacaattccaagagtggcaagttacacattttagaaatcatttcaccttggttacagttcacactaacaagttgtcattgcatggctaatcgaactgcaaataacactaacatggtgctatgatacatcgacgtgacagacaacctacccagatatcacatgacccagaaccaatccacaatggaaccaatgacaaggccaacaacgaggaacatcactatgacgatcccggcagtatacgattggtacatgggcacagccttgggcgccaagatcattatgactgaggtcaagtacccgttagtgaaccccaagatgcacgttaacacggtgaccgggatc

SEQ ID NO: 81081 - DNA, 218 bp, Zea mays
  Clone ID: LIB3088-025-Q1-K1-D7
aaaaaaaaaatttaaaatttaaaaaaaataaaaaaaaaaaaaagaaaaagtttaaatttaaaaaagataaaagggcatccattcttataattctatacttactaacactttctttcaatttcatatctcttctatattcacacttaaattcaattctcttttccttatttttacaactttcttaactttttaaaactccttttcttttactcaaattt

SEQ ID NO: 81082 - DNA, 151 bp, Zea mays
  Clone ID: LIB3088-025-Q1-K1-D9
ttcacgaagaattaacataggccaattatatcttttttaatgatgtatactgagtttgcggtgatcaggaccctgtgtcaccacctgggtcaattttactaaacattagcaccactagccttaaatacatactacaaagtctgatttactc

SEQ ID NO: 81083 - DNA, 257 bp, Zea mays
  Clone ID: LIB3088-025-Q1-K1-E1
gcgcccacgcgtccgaccacgcgataccattcttatacttcataacatcttcaggatttcaacagaccaggttgaacactaatggtgatctgcgtgaacatgctcatacactgacagagataaaatatttcaaaaaagtgatgaccttcattgagccacatctagtacccactactctacaattgattaccaactacatactctcatgacgaccctataactaaatacttattaaagcatatcatgattggcacaat

SEQ ID NO: 81084 - DNA, 343 bp, Zea mays
  Clone ID: LIB3088-025-Q1-K1-E10
gaattcccggtcgacgacgcatccgatcacgacaaccgctacagacgctcagactatccataatagaaggaaacggaatggctgagcgcctattcctaatctcgtgcgaagaacactacgaaactttttcgccaatactcgagaaaggtgctagcgtactcactgtcgaacttctactgaaccgcatatccatatataaacttgagttcgagatgcaaccccttttcattgaccgagtcaaacagacccgttcgtctcgcttgttgaatgacactgtgcatggccggtttgtacatgtacccaaccgtacatcagcctattcagttcaagaccaatgtatatg

SEQ ID NO: 81085 - DNA, 297 bp, Zea mays
  Clone ID: LIB3088-025-Q1-K1-E11
gactctaccggtttctactctgcctacctcatcttttatatagttgtcttgaccaccaatcacaagtatgaggatcattacatatgggagtcgcaaacttacatttcattcactgttactcatgacacttcagggcatcagcttttaatgggcactaaaatcacactgttccttaaagactatcatctgtagtacctttacgatcgtctcctcaaggatcttttcaacaatcactctgagttcatcaactaccccatctccctgtatactgaaaagacaacatacaatgaaatttct

SEQ ID NO: 81086 - DNA, 345 bp, Zea mays
  unsure at all n locations
  Clone ID: LIB3088-025-Q1-K1-E12
cccacgcgtccgcccacgcgtccgctcctcgcattttccttgcaaccgattgccgatccgggtgccaaccaaagacggatggcgcccaaggccgagaagaagcccgcggcgaagaagccggtggaggaggagcccgcggccgataagacgaccgccgggaagaagcccaaggcggagaagcgggtccccgctggcaagtccgccggcaaggagggcggctagggcaagcgtggcaagaagaagggcaagatgagcgtggagacgtacaagatctacatcttcaaggtgctgaagcaggtgcacccggacatcggcatctccttcaaggtcatgtncatcatgaac

SEQ ID NO: 81087 - DNA, 377 bp, Zea mays
  Clone ID: LIB3088-025-Q1-K1-E2
gcgcttatccagcggcggcaagctctacgactactgctcgcccaggacctcgctgtccaggatggtggagaagtaccagaccaagtgggggaagatactgtggggtgagaagcacaagaacctgagtgcagagatcgacagagtcaagaaggagaacgacaacatgcagattcagctcaggcatctgaaaggtgaggacctgaactccctacagcacatggagctgatcgctattgaagagggcctccagaatgggcagaccaacatgcgcgagaagcatatggactactggaggatgcacaagacgaatggaaagatgctggaagacgaacacaagatactgacttttatgatgcaccaacaagctgttgatctga

SEQ ID NO: 81088 - DNA, 327 bp, Zea mays
  unsure at all n locations
  Clone ID: LIB3088-025-Q1-K1-E3
acgcccacgcgtccgctgtcgtcgagtcatatttattgtgatcatcatggttgtttggaggacaganaggcgagcggagcctgtgtaggtgttgccatgagaagaccaaagaggcaaatgccaggtccaaccaacgtgagccctctttgttttggacttttggtggtgatgttgaccagaccattgatgttgaagtggcaagaatgtcagtgtcaacagtaatcggataaatagatggtatttccctgaccctttgtttgtagaacttgaatgaacctggggacagaaacacatttgagggttcttgtataaatcaaggtcaagatc

SEQ ID NO: 81089 - DNA, 270 bp, Zea mays
  Clone ID: LIB3088-025-Q1-K1-E4
cagatccaatcggacgcgactggcaaccttctaccgtatatctcacgcaaacgcaaggccggcaagtgtctcattaacaacggcgcgaagcgtcacctgaaggtccttcccaacaacatccagaggatcacgaaccccaccatccagaggctcactaagacggctatcctgaagctcatctgcaggcttatctactagtacaccctctgcctgctctacatctttatccacaatgtgatccacaactctgtgacctacactgatcacgcc

SEQ ID NO: 81090 - DNA, 452 bp, Zea mays
  Clone ID: LIB3088-025-Q1-K1-E6
cctcaaccaaattcaaagtcacagcggcgaaactctcggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttcctcgagaacgtcatccgcgacgccgtcacctacaccgagcacgcccgccgcaagactgtgaccgccatggacgttgtctacgctctcaagcgccaaggccgcaccctctacggtttcggcggttaggtcgcccctctcccggtggcgaattacgtggtggcggtggcggtcgtgttgtgttcttggtctagttagtctgtgttgtctttatcggtgctggtttct

SEQ ID NO: 81091 - DNA, 333 bp, Zea mays
  Clone ID: LIB3088-025-Q1-K1-E7
acgcccacgcgtccgctcagatccatgcaaagatataaaaaaaaaaaaaaaaaaaaaaagaaaaagaaaaaaaaaaaaaaaggaaaaggaaaaaaaaaaaaaaaaaaaaaaaaaaaaaaaaaaaaaaaaaaaaaaaaaaaaaaaaaaaaggccgccctttttaaagaaccaaagtttacatccccgacattccaatttaaaacttttttaatagttacaccaaattcaaattcattggccatattttaaaaacttattatctggaaaaaccttgactttaccaaattaaatccctttgaaaaaaatccccttttttcaagttggcttaatacc

SEQ ID NO: 81092 - DNA, 364 bp, Zea mays
  Clone ID: LIB3088-025-Q1-K1-E8
ggactcatacggcaaaggactactaaccttgtgaagcggctttagcctactgaagtgaagtcccgagaaaggtcattttggatccggcgtcggagtgacacggatctactaccccaagggcttttaatgggtcatggaggatgtccccacaagcgcagcttcattccagcagtcatactgtttcatgactggtgaggcagatccagcaagctctactacatcaaataacgattctgcttcctttgaccatccatttgcttgatgtatgacacgcttttcactgggaaaataacacttaaagacacatttctgtgttttcaggaagaaaagatatacatttgttcaagtcattcaccatcattcc

SEQ ID NO: 81093 - DNA, 297 bp, Zea mays
  Clone ID: LIB3088-025-Q1-K1-E9
ttcacgtaccaaccatatgaccctacacacatctagtgaactgaagaaagacacaagaggggatagcgaacattcctactgcctatggtatacctacatatatatatctgaacaagtcccaccggcgagcacacacactgccacccgttcacagcaggcgaacctatcaatatattccgattccatactactgataccgaactaggcttacactacctcaagaaaaaatctagctccactcctttttcggatgcaatcatagctgacgttgatatgtacaagtttgatccatgcaaa

SEQ ID NO: 81094 - DNA, 340 bp, Zea mays
  Clone ID: LIB3088-025-Q1-K1-F1
tattttattattatttttttttttttatttattattttttttttttttatttatttttttttttttttttttttatttttttttttttttttttttttattttttttattatattttatttattttttttttttattttattatttttttattttttttttttttattttttttatttttttttttatttttttttttttttttttttatattatttttattttttttttttttttttatttttatattttttttttattttaattttttttttttttatttctttttattttttattttattttctttttttttttttttattttttattttatttttt

SEQ ID NO: 81095 - DNA, 253 bp, Zea mays
  Clone ID: LIB3088-025-Q1-K1-F10
agacggcgactagagcatggcgttccagtttcggatgctggatcggtctgggctcgagagtcagagtcactttccatcgtgggggatgagcgagcccgttgacatgtgcctccgcacggctctgtatgagtcccacgccatcatcttctgcgtcaaggaccaccttctgcgcatggcgcgcttggacagcgtcttctttagtagagcgtcatcttgaactccaacctgctcagaccctctcaatgctttacgt

SEQ ID NO: 81096 - DNA, 381 bp, Zea mays
  Clone ID: LIB3088-025-Q1-K1-D5
tcttgatgctgcgaaggctgtgagattgattatactagcgagagtccgaagtcctgagttggcaactcaaaacttaggggggcttcctgacgatgatgaatttgtcttttcttgtttcaccttgaaagcttctccgcagcaagggtagcttggcaggatgctgagccggttcggaagcgctttgctacgacttgtttctccgactggcatgctgttcaacaaaaacttcaaccaggtcgagtacattgaggcaaaaacgacatgaagatgcactgtacccatcacaagaggtggtatgatgaagatgtagaaaatgacgcacagaaacctggaaagatgaatatatgcaaaatgattcgcaaaaaccatgggaagatcatt

SEQ ID NO: 81097 - DNA, 382 bp, Zea mays
  unsure at all n locations
  Clone ID: LIB3088-025-Q1-K1-F11
atcccctggtcggccgactcatactgcttctactctatctcgactcatttttcgctctctantctccaccccttcctctagcaatagtaccttctcaacccggcaaatgatctcactaattatgattctattgctaattcaactttattctattgctcatttttaggatgtactctcctgattccctactaatgttttttctattttccctaaacatgatttctcaatcactatcaatgtgacatgaaacgaagcttctacatctttgatttccaatatagttaatcctatttttattaaacatccatctctctcttcattataaattcattataagttttattatcattttacattcacttttatcattttacaatttctt

SEQ ID NO: 81098 - DNA, 334 bp, Zea mays
  Clone ID: LIB3088-025-Q1-K1-F12
ggtctagaaccaccgggtcgaccgcacgcgtgcgcatactcgtgggttgcagaatatttgggctttcagagctcgcaactggcaattcgcatctgcttatatttgatatgcagcaagcctgactatcacaaacatgtgaggaatgccgttgtaaatcagctgaaggagttcatgatacactataaaggttatgttccaatctaatataacgtacacttgcagaaaactaaaaggcctgaggaaatcggataccatgttaccttacatgcatgttcagacaggttagctgctaaaatctatttgttgactatctttcacatacacatgcctattt

SEQ ID NO: 81099 - DNA, 304 bp, Zea mays
  Clone ID: LIB3088-011-Q1-K1-H3
acgcccacgcatccatccacattttcctactattgaagctgcggttgcagtggagcgtccgggggtcaaggaagcggtggatgtggctattgatctgaatccacctaaaattatataacttgcaacgacaatggacattactcaactcttacacacagctatgaacatgttatacaaatatgacaccacacatgaatatgtctagctaagaggcatagctgtctgatgcatatcatgtgtaacacctcaaggcttgtcatgtagttcatgaaactggcatgatggtatacattactctcttcaa

SEQ ID NO: 81100 - DNA, 426 bp, Zea mays
  Clone ID: LIB3088-011-Q1-K1-H4
cccacgcgtccggcaagttgctcttgcggtagttcccccaactgtcaccatgcagaacgaggagggtaagactgtggacctctatgttcccaggaagtgctcggccacaaacaggatcatcactgccaaggaccatgcctctgtccagatcaacattggccacttggatgcgaatggcctgtatgatggtcacttcacaacatttgctctctctgggtttgtccgtgctcagggcgatgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttagtatctttggtgggttccttc

SEQ ID NO: 81101 - DNA, 308 bp, Zea mays
  Clone ID: LIB3088-011-Q1-K1-H5
cccacgcgtccgcccacgcgtccgggctatggaagcggtggtggcggtggaggtggcggtggtcaaggtggtggtggctctggctatgggtctggatccggctccggttatggaggtggcaacgacaacggacattactaggctctttttcagagctaggaacatgttatacaaatatgtcaccagacatgagtaggtcttgctgcatgggatgctagttgtgtccatcgtgtgtgtaacaccgcaaggcttgtaatttgtcctgtaaactgcttgctgctttacattactggcaacaactaagtgat

SEQ ID NO: 81102 - DNA, 404 bp, Zea mays
  Clone ID: LIB3088-011-Q1-K1-H7
gggccgtcccaattgtcataatgctattatttggggttctttactggagatgcttcggtggtagaaggaagcggggaaggggttcgctcctcccattgtacaagaattcttataactcgagtcgtcgctcgagatcagactagttatacacgcaatgttcaagtttttttcttttaaagaatggtacaaaatatctgcctgtagaagaagctaaactgccgaatgtggatcatctgtaagtgcttttggatgggcatgttttgatggtgccctgccaatgtatctccaattctttttggtggatgaagagaggcggtgaagctgctagtatggggcggggcacctgcacaaagcctcatttgtaattcataccagggtaccttttctgtagctagattattctt

SEQ ID NO: 81103 - DNA, 373 bp, Zea mays
  Clone ID: LIB3088-011-Q1-K1-H8
gtgcggcacgttcgaactggcattaggctcgcatactgggaccattactgacgaggctgttgagactgtaggacccgtatgttcgcattaagtgcttcgacacacacaggatcatatctgtcgaggaccatgcctatatccagatcaacattgacccattggatacgaatggcctgtatgaaggttggttcacaacatctgctttctctagatgttaaactgctcaaggcgaatcatacagctgctctgacagattgtcacggaataataatgctgatatcatgcattataaattacatctagtgtaccaagagatgcacactgacttaactatattttgaattcatgctactatatgccatgttgggaattc

SEQ ID NO: 81104 - DNA, 243 bp, Zea mays
  Clone ID: LIB3088-012-Q1-K1-A10
tggtggtgaatcttgaattcttggttttttttttgcaaagctttagccaataattcgttccacgaaccttttctgttaatccggcaaatgtttggagccctgtgggtaggatcccgattggttggcttccttgaaatttaaccggcttgcctttatggtggaaggctttggcgcctggttaaaaaaaaaaaataaaaaaagggcgggcccttttaaaggtcccaggttaccgacccctgcctt

SEQ ID NO: 81105 - DNA, 369 bp, Zea mays
  Clone ID: LIB3088-012-Q1-K1-A12
cggtttctgggatgcctgctgatgctcatggttctataggaaggtccacaaaccttgtagatccatcacttttctcaccattgacgtcttcacagacaacaatggtgtgcactaattctgtagtagcaattgctccacctcaacatcctcagactgctcagcagccgcaaagtgctcccttgcttcagccttttctattacctacggcttcaccatcttcaccatatgggactccattacttcaaccgtttccgccacctaatccatcgccatctcttgcgtctgcaccagtcttgagtccaacactgtctagagacaaagtcgagatgcatactgagacttgtggagacgatgaatcatagattagtc

SEQ ID NO: 81106 - DNA, 317 bp, Zea mays
  unsure at all n locations
  Clone ID: LIB3088-012-Q1-K1-A2
caaaggacaatgttggaattgctgaaccagcttgatggatttagcaccgatgagaggataaaggtgatagctgcaacanatcgtgctgatattcttgatcctgctctgatgagatctggtcgtctggaccgtaagattgagttccctcatccatcagaggaagcaagagctagaatcctgcagatccactcgaggaaaatgaatgtgaatccagatgtcaactttgaagagttggcgcgttcaaccgatgatttcaatggcgctcagctaaaagcttgttgcgtaaaggctggcatgctcgctctacgccgagatgc

SEQ ID NO: 81107 - DNA, 361 bp, Zea mays
  Clone ID: LIB3088-012-Q1-K1-A3
ttcatttggcgcactagggagtggagagcgatagagttggaaggtggaatcagaaatccgcggcgaatacagggactagggggatctggagctcctgaggaggaggagtaggtaggagctgtaattgtaacggttggcagagggggatcctctcgatctgttcttgagctggaagactcccatcttttgagccgcggagccggagaaacttggatctcgaggccctccaagagaaaccgtttctcgctgatagcctcctgcattgctgcctctcccccttaacacccgacctgcccacaaggagaagggtggaatctctgctcgccttccccactaatcggctcagaatctgggttccttg

SEQ ID NO: 81108 - DNA, 374 bp, Zea mays
  unsure at all n locations
  Clone ID: LIB3088-012-Q1-K1-A5
cccacgcgtccggtgcaaggggacgtccaagtacgtgcaccgcgactgcctcgaccactggagggcggtaaaggagggatttgcattttctcattgtactacctgcaaggctccatattacttgagggttcattcgcacactgacaggaaatggcgaacactgaagtttcgtttctttgttactagagatatattattcatctttgctctagtccagattatcatctctgcattggcatatttggtacattttattgatgggtgccaacaatattggttgaagacagcctgngcttttgataatgaagttagtttttattatatctgtggtgcattaaatgtttttgctttgntgggactatcgggatgcttca

SEQ ID NO: 81109 - DNA, 206 bp, Zea mays
  Clone ID: LIB3088-012-Q1-K1-A6
gaattccactatcgaccgacgggtcccctcacttcatataccactccctatgaggactcaatttcacacacagccgacctttgtttaggctggattaacaggaaggcaggagactcatactgcatgtcatgccatcacctcaacttcatccgtcgatacatatgccagctctctaccgatccacgttgaattccttatctttgcat

SEQ ID NO: 81110 - DNA, 350 bp, Zea mays
  Clone ID: LIB3088-012-Q1-K1-A7
cgcgtccgcccacgcgtccggtggtgtctggcatggccgaggtgataccatttgtttagggagcaacggtgcaggaaacaaggctttcgctgccctgaacaaggcctctctcgtgcctataaagtccccggggctgtgtggcatggatagatcgtcaagcgcagccgacgagcagcagccgcttgtcccaccggatcaactggagcaggtttaggtattctctgtcgccacgacctctgcactttcctagaagggcttggacagcgccgacggaaaaaaaaaaaatcgtcctctgccggattattaggcgcctgcatctgcatccattggtcccgagaactggactttgc

SEQ ID NO: 81111 - DNA, 317 bp, Zea mays
  unsure at all n locations
  Clone ID: LIB3088-012-Q1-K1-A9
cccacgcgtccgcccacgcgtccgctcatgatgcacaacgggacctactgcgctgaaattgctcacaacgtgtccactaagaagcgcacggagatcgtggagcgtgctgcgcagttcgacattgcggtcacgaacaagcttgctaggctccgcagccagtaggacgagtagtctgatttcttgacttaacgacgaactggatgctgccattcctttctgtnggaaactacattgctngtgtcttgttaagtactgaaaaccagagtcactcctaacctttttgcaatcagtagctactaaaatgtggcaaanaaaaa

SEQ ID NO: 81112 - DNA, 362 bp, Zea mays
  Clone ID: LIB3088-012-Q1-K1-B11
agaaggatgggcttcgagaagcagatcctgagatccggcaccggccccaagccgataaagggccagaaggtcaccgttcactgcaccggctacgggaaggatcgtgatctgtccaagaaattttggagcaccaaggaccctgggcagcagccattcagtttcagcattggtcagggttcagtgatcaaaggatgggacgagggagttatgaccatgcaagtgggtgaagttgctcgtatccagtgcacgcctgattatgcttatggagccggcgggttcccagcctggggaattcaaccaaactcagtgcttgtgttcgagattgaagtcctcagtgcccagtaattcgcatctgtcagcta

SEQ ID NO: 81113 - DNA, 365 bp, Zea mays
  Clone ID: LIB3088-012-Q1-K1-B12
ggctttggaagagaccgagaagcgcctcatggaagagtagatctatcgagttctaaggtggcgtgatgtctgctcctggtcttgagaagatatcggtaaaatatcatggctcataggatatctagtgtatagtcttcttgcagcacagaagataatgttttgctgcttcagcaaacatctgaagtatgagtcttattattaagaagtctttcctttaacttatggcgagtttagcatcggtcagttatcaaacagttaaagcgtcgtctgaaatcttgtctgaatatcaaaaaattaaccaaactcaatgctagtgttcgagattgaagttctcaatgccccactaattcgcatctgtcaaataa

SEQ ID NO: 81114 - DNA, 169 bp, Zea mays
  Clone ID: LIB3088-012-Q1-K1-B2
catggactgaggtattaacaccggcagccaatcagaaacttcaggaagaggtgacaaagccgcaccctcaatgtgcttgcagcagaaaacggtgaaaatggcaatgtgtttaaggtctgtgatgactcagttaatgttgtcaaccttgacacatgggaatgcacctgcc

SEQ ID NO: 81115 - DNA, 441 bp, Zea mays
  Clone ID: LIB3088-011-Q1-K1-H2
attttggggaacacctgaaggggatgtttttcatcctgttgaatgcatgcatgagttgcttgatacagttcggcgccacaaagtcaacattgatggcaacatatgtactgtaatggttaccattttggtccttgaggggtggcaacgcaagctggacccaggctttgatatcatgcaaacgttgaagactttactgctagagaaggacataaagcaaccaattgattttttctcataaacaaacctgtcagatcgttcttatgtatagaagcagtggaagatgatgccctaccaatataatcagaaggcgaaacatctaatctaactcgaagcaacctgacattaattgagcagatatattatgcactatgttctatctgtcctttctgatagtagaagtagcagaaactgtctgcactgagtttcattttttactacgtc

SEQ ID NO: 81116 - DNA, 316 bp, Zea mays
  Clone ID: LIB3088-012-Q1-K1-B3
gagcattattgattatgtacatctattaggtacattatttccttgtcaattgaatacatgacttgcgatgtgttaggatactggtagtaaataatagcgtgtatatgttactactcttttactctttttgtcattattatattatcttttgttcatcctgtttgatatcagttaaagggtattctttttttactatatgctttttttattataatttttatctttatttttattttattttattatttcttttttttttttcttttattttttctataattttctttatataattttttatttatttttatatttt

SEQ ID NO: 81117 - DNA, 255 bp, Zea mays
  Clone ID: LIB3088-011-Q1-K1-E6
acccacgcgtccgctcggacacggtcacaacatagcttgatttcgtgcttgcccttactgaaggggactctggccagctctgactgccgactgtcgtctacaagaatggcatggtctagtccatccacgatgcttgtgttctgatcaagcctggtcgtatcaaggtggcaaggcatactggtggacatatcctatcgcatggtcacggtcgatatagattaccacatcgaattttgcctcaacagcgatttctgt

SEQ ID NO: 81118 - DNA, 442 bp, Zea mays
  Clone ID: LIB3088-011-Q1-K1-E7
aatcatcaattgatgaatctgctaggtactatctctttatttcacacactggatatggaggtgttgcttatgcgatggccattacctgcctgggactgagtgcagatgcaaagtttgtaatggaagaaacagcagaaacacactttgtatcaacatctcttgcgaaaaatgtgtccatcaaaactaaaactgacatagcacttaagcagggtgactaccgtgacatattaaaccttactagagtgttggtacatgggcccaagagcaaagaagaggttgacacagttattgacaggtgttctggtgctggtcatctgcgcgaagatattatgcattacaggaaagcactgcaagattgttcacatgacgacgacgacgactgtgatgaggaacactcttatctcactgatatgggcacaaaagctttgaggcgttacttttt

SEQ ID NO: 81119 - DNA, 452 bp, Zea mays
  Clone ID: LIB3088-011-Q1-K1-E8
cccacgcgtccgcggacgcgtgggccttgataaacctgatggctatcgcggagagctgtgttgatgcggtggtcatggagatggtggctgtctactgcggtggcctctatgccgccaagccagagcttgctgcccgccgcattgaggccatcggctttcaggttgggcaccagctctctgagagatataccatggagcgtccacgatttagtgatcatcttgaagcaatcaaatttatctgcaaagacttctggtcagagctgttcaagaaacagattgacaatctgaaaacaaatcataggggtacctttgtccttcaagataaccgttttcggtggcttactcgtgtttctctagatccatatacagagaacagagattcaactgaaaatgattctgcagcattgggtgatacagcagcccaaacaactaccatgcttctgtatttccca

SEQ ID NO: 81120 - DNA, 397 bp, Zea mays
  Clone ID: LIB3088-011-Q1-K1-F1
cggacgcgtgggcgagggagtgctctactgtaggcctcacttcgaccagctgttcaagaggacatggagcttggacaagagcttcgaaggaactcccaaggttgtcaagccagaaagaaacgttgggaatgagaatgctactaaagtctcaagcgcctttgctggcaccagagagaaatgtgttggatgcagcaagacagtctatccaactgagagggtcactgttaataacactatgtaccacaagagctgtttcaagtgctgccatggagggtgcaccatcagcccttctaactacattgcgcacgaggggaagctgtactgcaagcaccaccacattcagctgatcaaggagaaagggaactttagccagcttgagaatgaccacgagaagaca

SEQ ID NO: 81121 - DNA, 420 bp, Zea mays
  Clone ID: LIB3088-011-Q1-K1-F2
gtgagtgctcacacccatagggtttcaggtcctcccgacgttgaaaatccgaatcgaaggggacatagcagtagtgacgagatgctcagtgcaagtagtagagcagacgatagtagcagcagggacgctagatcccttttgaatggtgaggatggttacaaatctcggagtgcagtatctttgcccagcaaccaagttcaggctgagtggattgagcagtatgaaccaggtgtatacataacactgacaactcttcgtgatgggacccgagatctaaagcgtgtacgcttcagtcgaaagcgttttggggagcatcaggcggagagctggtggaacgagaaccgcgacaaggtctatgagaagtataatgtaaggagctccgaacgagtctcgtcggcatcatcgatccggtcaggtcga

SEQ ID NO: 81122 - DNA, 402 bp, Zea mays
  Clone ID: LIB3088-011-Q1-K1-F3
aacaagtcgtttgtgctgctctgatgaattaattcaattcaagccataaccaagacggtttccgcaatgttattgtgatgatgacgaaaaggggtatgttcaatgcaataatatgatgttcgactggaatttcacttaccgccctacaatgagtgcctcgtgggcttctaagatgtcaaatccacttctgccatacacattatcttacagctttacttgcgacctggcacatgatttttggttcctggtacttttgctgtggtatatcatatatgttgactaaatggctgtagaacgtagcatgattgcatactgcgaagtctgttaaaaaacttggtggttctgccagagcaactcacatgcaattgtgaaaatggagaacaaggaaaatttatttggctt

SEQ ID NO: 81123 - DNA, 199 bp, Zea mays
  Clone ID: LIB3088-011-Q1-K1-F4
gacatgttccccgtagcatgtgatgggtgtctcttggtgtaacgttacgtactagcttgactgaacgcgttgcatgtctggttcagtactggaactggaagcagcagctgaaactgctgacaacgacatggcagtgcagcacagtgcggctgttgggcgcaaaatgctttgattattcctgcagcacattctactttga

SEQ ID NO: 81124 - DNA, 397 bp, Zea mays
  Clone ID: LIB3088-011-Q1-K1-F5
ccagcaccagccttggactggtgtgtgctgtatgacatagccctcggcactgcccatgggttagcatatctacatgatgactgccgccctgcgatcattcatcgcgacatcaagccaagtaatatactgctggacaaggacatggtgccacatatttcagattttggcattgcaaagctcttggagcagccttctactgctcctcagaccactggtgtcgttggcaccattggatatatggccccagagttagcgttctacaccaagagcagcatggagtccgacgtgtacagctacggcgtggtgctgctggagctgctcacgaggagggcggcggtagatccctcgttttccgacggcacggacatagtcagctgggcgtcgatcgccctgaacg

SEQ ID NO: 81125 - DNA, 400 bp, Zea mays
  Clone ID: LIB3088-011-Q1-K1-F7
agctgccgccgctgagcccgaggcggcctccgtggcggcggaggaagagacgccaaaggaggaagagacggcaaaggaggcggagccggagccggagccggcggcggctgaagaggtgaaggaggaagcggcagcgcccgctgccgagacagaagcagaaccggcagccgctgagcccgaggctgctgctgctgctgaggagcccgcggcggctgagccggccgctgaggagcccgagaaggccgagccggccgctgaggtggccgagaaggccagcgagtgaagccgtgcgccgtacgcgcactggggcagcggacagcgggtcgggagatcgatgtcttagcgtgcgcgcgtggcgtgccagtctcgttgcgcgcgcttgcgcctactggtcaataca

SEQ ID NO: 81126 - DNA, 400 bp, Zea mays
  Clone ID: LIB3088-011-Q1-K1-G1
gtttgactttaacccagatgtttagggattgttcgagcagcaaactgtgacagtatgtatgcatcgacaatttaaagctgaagtctggacggtttccatgcttttgggggcggatttcctttgttgtccctttacccatttgtcaaatttggtagcggtggttggggggagtggggaatgaagtgagaaggctatgtttataactgtgaaccgacggttgcagctatacatatcgtcatgcctgtgtactcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcc

SEQ ID NO: 81127 - DNA, 254 bp, Zea mays
  Clone ID: LIB3088-011-Q1-K1-G2
cccacgcgtccgcccacgcgtccgcccactcgtccgcggacgcgtgggattttttcttagatgttctctcaagttaaggcttaagaaccagaagtgtgaggattgtttcgtattagatattctgccttgccttgtactacttccttctccgagtattgtaatgactatacaatctgttggcttgtattgtaccgctgctattgacccagccagtattttactgcacgagaaagtggtgtgcacgaactattctt

SEQ ID NO: 81128 - DNA, 365 bp, Zea mays
  Clone ID: LIB3088-011-Q1-K1-G3
cggacgcgtgggcggacgcgtgggcgggtgggcagaagaaatcattggaagcagcaggcgctatgcagccttcaagcaaaaagcagaagacatctggaggctcccaggaacaaagtatcgatgaactaaatgatgtcacagccgctagtggtgttaatattagggaagaggaagaacagttactgtctgcccctaatgaagagagccttgcctcacaagaagcacgaagaattgcaaaggaagaagaataaaatcttttcctacgtaagggtccacttttgaggaaactagcataaatcgctctgaaatgtgatctgaaaaatattattgacgatttggaaacttgaattttaatgagtgtttag

SEQ ID NO: 81129 - DNA, 457 bp, Zea mays
  Clone ID: LIB3088-011-Q1-K1-G4
cagagactctataccaaatgtttattatcaatgctggtccgggcttccggctacttggagacactctcaagtccttccttgatcccaaaactaccgccaagatacatattcttgggaacaaataccaaagtaagctgcttgaaaatttgacgctagtgaaatgtcagaattccttggtggcacttgtacttatcctgaatacggaggttgccttaaggctgaaaagggacaatgatgcgagggagtggcacatcaactgctgagtctggctcaaaagaagttgatgatgctgtctccgtacaagctctcagaagttacacatcacatcctaagttgacccgagttcgtgaagaggcttgtgatgctacatgaaagagagagcaaccactaaaggcaccattcgatccccaagtttaagctcttcaaggtgaggtctgttcaatttggctagaaaggc

SEQ ID NO: 81130 - DNA, 446 bp, Zea mays
  Clone ID: LIB3088-011-Q1-K1-G5
gagccacaagcgtatggattagacgcagcatccaaactgtgacagtctgtgtgcatagagcatttaaagctgaagcctggacagtttcaatgctatggggggcggatttcctttgctgtcccttaacccaatgcgcaaaattggccgcagggcgttgctcggagtggcgaacgaatcgacaacgagctcgccatcactgtgaaccgaactctgactctctacgtagtcgcctgcctgagcacctaccacaaccagggacgagacagagcgcgtgttccgcaagttcgacgcgaacggcgactggcagatctcgcggtccgagctggctgtgcttgtcgagggcgtgggccacgccgtgaccgacgactaggtgtctcgcatgatggacgaggattgagctttaaaattttttaacccaatgattctaattttttaatttttttttt

SEQ ID NO: 81131 - DNA, 249 bp, Zea mays
  Clone ID: LIB3088-011-Q1-K1-G7
ggcatcaccaagccggcgatccggaggctggctcggaggggcggcgtgaagcgcatctgggggctcatctacgaggagacccgcggcgtgctcaagatcttcctcgagaacgtcatacgcgacgccgtcacctacaccgagcacgcgcgccgcaagaccgtcaccgccatggatgtcgtctacgcgctcaagcgccagggccgtaccctctacggcttcagaggctaggcgcctgttcttagctgggga

SEQ ID NO: 81132 - DNA, 347 bp, Zea mays
  Clone ID: LIB3088-011-Q1-K1-G8
acccacagcagcttctatgccacatgggcatgtatcatggctggttcgggcttacggctacttgggacactctcaggtccttccttgatcccaaaactaccgccaagatacatattcttgggaacacataccaaagtaagctgcttgaaaatttgacgctagtgaaatgtcagaattccttggtggcacttgtacttatcctgaatacggaagttgccttaaggctgaaaagggacaatgatgcgagggagtggcacatcaactgctgtgtctggcataaaagaaggtgattatgctgtctacgtacaagctctcacaagctacacattacatcctaagttgacccg

SEQ ID NO: 81133 - DNA, 391 bp, Zea mays
  Clone ID: LIB3088-011-Q1-K1-E5
gcgcctgaagttgccatcattgtccttgggcggattcaaaagcttcctcgcttcgatgatgacgaaaacgtttacccttcatccataatcaatgttactgttggagccgatcaccgagttgttgacggggccacggttgcaagattctgtaatgaatggaagagcctcgtggagaagccagagctgctcttgttgcatatgcgatgacccagtaatgtaccggtacatactacgacctgaaacggaggcattttggcatataaaaataaatccatgtatttaaataaataaccaacgtggcgtttttgtctggaaacagtggaaataaattgggagttattttcggagtgctaaaaaaaaaataaaaatattatattttttttttttttat

SEQ ID NO: 81134 - DNA, 51 bp, Zea mays
  Clone ID: LIB3088-011-Q1-K1-B6
gtgacattgatagttgaatttaaattaggcggaaaaggcagccggctgaag

SEQ ID NO: 81135 - DNA, 202 bp, Zea mays
  unsure at all n locations
  Clone ID: LIB3088-011-Q1-K1-B7
acgcgtgtgggacgacggacgccaaggcgcaagctgacggtcaagctgctcangtcgcggaggaccacgatctgtacactcgcgatggccttgatcgccgaccgtagagtgaggaaccggatcacttccaccgaggtcacctatgacctagttgatctcatcttgtgcatgacgaagggcaagcccatcgacgtgacccacg

SEQ ID NO: 81136 - DNA, 421 bp, Zea mays
  Clone ID: LIB3088-011-Q1-K1-B8
cccacgcgtccgctcgagttctcctcaaccaaattcaaagtcacagcggcgaaactctgggcgatgtctggccgcggcaagggcgggaagggtctgggcaagggcggcgccaagcgccaccgcaaggtgctgcgtgacaacatccagggcatcaccaagccggcgatccgcaggttggcgaggaggggcggcgtcaagcgcatctccgggctcatctacgaggagacccgcggcgtgctcaagatcttccttgagaacgtcatccgcgacgccgtcacctacaccgagcacgcccgccgcaagactgtgaccgccatggacgttgtctacgctctcaagcgccagggccgcaccctctacggtttcggcggttaggtcgcccctttcccggtggcgaattacgtggtggctgaggcggtct

SEQ ID NO: 81137 - DNA, 67 bp, Zea mays
  Clone ID: LIB3088-011-Q1-K1-C2
ctgagactgtggaacttcagattggtcttatagaattatgatccacagaaggacaagcggggcattt

SEQ ID NO: 81138 - DNA, 417 bp, Zea mays
  Clone ID: LIB3088-011-Q1-K1-C3
caccggaggcagcggccgtgggaaggcgatagccagcgaccaagtctgtgtcgcggtctgccaaggctgggctccagttccccgtcggccgcatcgcgcggtacctcaaggccggcaagtacgcggagcgcgtatgcgccggggctcccgtgtacctctccgccgtcctcgagtacctcgccgccgaggtgctggagctggccgggaacgctgctcgggacaacaagaagaaccggatcgtgccgcgccacattcagctggcggtgcggaacgactaggagctgagcaagcttctgggcactgtgacgatcgcggccggctgcgtgatgcctaacattcaccaaaatttgctgtctaagaaggctggtaacaagggggacattggcttcggcttccatgagtttttaacgccttttt

SEQ ID NO: 81139 - DNA, 437 bp, Zea mays
  unsure at all n locations
  Clone ID: LIB3088-011-Q1-K1-C4
ggaaggtgaaacaactacaacggaaactacagagaaagatgctgttgcgaaagactcctgccctgtatgttccgcatcaggtatcacaaggaattccgataatatgaaacctccaaagctggagtccaagtgcaactgtataatcatgtaagtaacttcacgtccaaggtcgaaggagttgtgatattggttgggacgaaaatccatgctttctggtttcatgtcacatgcaacttgaagcatgcctacctgcttggttaacccgctgtcagcagcaacgatggagttcaaggcagtggatcttccactagattattttgcagaagtgcatttgctgtgttttttaggtgacagaatgcactgcgagctattctttngtaaagtcttttcttctcttgtgtggaaattttctgcttgtcgtgaggtctattgcggtt

SEQ ID NO: 81140 - DNA, 325 bp, Zea mays
  Clone ID: LIB3088-011-Q1-K1-C5
cccacgcgtccggtcaaggccatcgagaaggtgggcacccgcaacggctgcacctccaaggtggtcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctttgcttgattcgtgtttcacctgttatgttctgagattcatgataatgcta

SEQ ID NO: 81141 - DNA, 298 bp, Zea mays
  Clone ID: LIB3088-011-Q1-K1-C6
cggacgcgtgggcgcggtggtgactggtgagtcgacactccccactccattttctaccatcacactgacacgttcatagctagctagtcttcagctagtaacttacgacgggataatctcgatctgggagcgaggaggaggacgacgacaatgaagatgagctccgtgccagcggcagcggcggtgatggtggtggtggtgctgctgctatctgcagcagcgacgactgagactgggcatgcgcttgtgccagccgtgatgatcttcggcgactcagttgatgacgccggctactaca

SEQ ID NO: 81142 - DNA, 314 bp, Zea mays
  Clone ID: LIB3088-011-Q1-K1-C8
gccacgcgtacgggtgtcgcctgcgacagtgattgcccagctgctctgcatgatcagcgtcacagcgttcatggacagcgtcgttggagtctacaatggctcgtccttcgacccagtcgagatcatgcttgtgatcattgaccgctagcttgcaatgtcatctatactgtactagtcgatcttgcacgatacgcccagatttggagccacatagtagtcgcatgtgatgcttgtgtaatgatatgataccgagatctgtatctatatatgggggtccacaggcattgcgacatgaggatagctgctagacacga

SEQ ID NO: 81143 - DNA, 366 bp, Zea mays
  Clone ID: LIB3088-011-Q1-K1-D1
cggacgcgtgggcgggcggcaaggcccctaggaagcagctggcgaccaaggcggcgcgcaagtcggcccctgcgaccggcggcgtgaagaagccgcaccgcttccgcccgggcaccgtggcgctgcgcgagatccgcaagtaccagaagagcacggagcttctcatccgcaagctgccctttcagcgcctggtccgcgagatcgcgcaggacttcaagaccgaccttcgctttcagtccttcggcgtcgccgcgctgcaagaggccgccgaggcctacctcgtcggcctgttcgaggacaccaacctctgcgccattcacgccaagcgcgttaccattatgcccaaggacattcaacttggccggc

SEQ ID NO: 81144 - DNA, 485 bp, Zea mays
  Clone ID: LIB3088-011-Q1-K1-D2
cccacgcgtccgaaaaaaaaaaaaaaaattaaaaaaaattaaaaaaaaaaaaaaaaaaaggaaaaaattgaaaaaattaaaagaaaattaatactacatatttatataaattatactttaaaatctctttaattataatttatagttattattaaatatattattttaataaaattcatattgttataaaattaaaatattttttggaggttatacttctgtcgttaattatcttattctcttattgttctatttctattttgctatttgactttttattctttcttttttgtaaattttttatcttctttttaatttgtattacttatctggctaatttaattgttacttttattgattcttttacatttttttattttttttttttaattttatatttttactttttttattttcctattttactatattttattttttatattttttattatttttctatatctttttatatattctttttt

SEQ ID NO: 81145 - DNA, 251 bp, Zea mays
  Clone ID: LIB3088-011-Q1-K1-D3
gcggaggcgtgtaatcactcgtaagtaaccgcttccgaggttctgaccattgctgtcaaccggggggactcgtcaacagcgaagggagtttagggacctcgtatgtctaatggttgaccctttgagaccaggagacttcaaccaagcgctaattgagttaggagcaacatatatgtatcaagacaaaacctggttgttctcaatgcccactctctagccactgtcaagcgctttcgctttcccgtgtaaaa

SEQ ID NO: 81146 - DNA, 447 bp, Zea mays
  Clone ID: LIB3088-011-Q1-K1-D4
agccgaaaatggaatcatccctcacttgatgaaatttgtcatgtcagactcacctctgcggcagtatgccctgcctttgctgtgtgatatggctcatgcttctcgcaactctagagagcagttgagggttcatggaggactagatgtgtacttaaatctgctggaggatgatgcatgggcatgcacggcattagattctattgctgtttgtttggctcatgataatgatcacagaaaagtggaacaagcactgttgaaaaaagaggccattcagaaattagtgaagttcttccaagattgcccagaacagtattttggccatatattggacgctttcttgaagataatcacgaaatcttctaggctaaatacagcaatggctaccaatggtttaacaacattgctcattgcaagacttgaccaatcagaagctattgcccgcttgac

SEQ ID NO: 81147 - DNA, 283 bp, Zea mays
  Clone ID: LIB3088-011-Q1-K1-D5
gcgcagacgcgtgggcaggcggcaaggccccttggaagcatctggcgaccaaagcggcgcgcgagtcggcccctgcgaccggcggcgtgaagaagccgcaccgattccgaccgggcaccagggcgctgcgcgagatccgcaagtaccagaagagcacggagcttctcatccgcaagctggccttgcagcgcctggtccgcgagatcgcgcatgacttcaagaccgacctccgcttgcagtcctacgccgtcgacgcgctgcacgaggcctaccaggcctacct

SEQ ID NO: 81148 - DNA, 112 bp, Zea mays
  Clone ID: LIB3088-011-Q1-K1-D6
acgcccacgcgtccggacggatgtggatagtaatatgcatgagtctggtatggggatggattatgatgaggatactgtgatggtgcctaaaaaggcccacaatatctaacat

SEQ ID NO: 81149 - DNA, 442 bp, Zea mays
  Clone ID: LIB3088-011-Q1-K1-D7
cccacgcgtccgcccacgcgtccgggctttacaccattgctgacaacccaaaggaatcgtcaacagtgaagagattctgggacctcgtaggtcaaatggttgaccctttgagaccaggagacttcaaccaagcgatgatggagttaggagcaacattatgtagcaagacaaagcctggttgctctcaatgcccagtctctagccactgccaagcgcttgcgctttcccgtgaaaaatcatcggttcaagttacagacttcccacgagtggttccaaaggccaaacctcggagtgatttcgctgctgtttgtgtggttcagattgcacaaggcttggaagaagaagcggcagacccaaagggaaatgaccatctctttttgctgatcaagagaccagaagagggcctgcttgcatggctctgggagttcccactggtccttgt

SEQ ID NO: 81150 - DNA, 192 bp, Zea mays
  Clone ID: LIB3088-011-Q1-K1-D8
aaaaaaaaaaaaaaaaaaaaaaaaaaaaataaaaaaaaaaaaaaaaaaaaaaaaaaaaagagaaaaaaaaaaaaaaaaaaaaaaaaaaaaaaaaaaaaaaaaaaaaaaaaaaaaaaaaaaaataaaataaaaaaaaaaaaaacaaataaaaagaagtaaaaaaaggataatggaagacaacatcaaataaaa

SEQ ID NO: 81151 - DNA, 430 bp, Zea mays
  Clone ID: LIB3088-011-Q1-K1-E2
cggacgcgtgggcggacgcgtgggcggacgcgtgggtccgggtggtgctctgaataagacgacactgaggacctatcaggaccgattgtttcgcaccggaggttttgatctatttggcccttgaatcctctgttcaatgtgatactgctgtcagctgtttgtcttgtttactgttgtacttatcaaattgatgttttagtcgattcgagtctacaagattgaactttgttgctacagtgagtaccgaccagtggcctttttgttgttgttgagaaacagccctcaacctttagcagagaaagggactaaacatgtcttccaacataaaaactaagggcctgtttgtttttgttttttgttaagcctgtttctttaggtttaatttgtaccgacttctactggttctactgtgtccccaggatttcaagct

SEQ ID NO: 81152 - DNA, 340 bp, Zea mays
  Clone ID: LIB3088-011-Q1-K1-B5
aacaatgtgaagctcgagttgcctgcttgagcatgcttcgttttgccagaaagcgtgcaagctacgtgactcaagttttctagaatttagctgcttatatggtcatggaaagacttggttatgacgtgaacaggtgcagctgatgccaaacccttgatcttgtctgcgaaaatcggcatggccaagaccattcgatttcaaagctaacagatgctgctgcacagaaattgggtcgtccctttttgtacctctatactttcgatatggaaaatcatatacagctcagttagtctgtctaacattcgagttcaattgctccaatacaaaaatgcgatccaat

SEQ ID NO: 81153 - DNA, 314 bp, Zea mays
  Clone ID: LIB3088-011-Q1-K1-E3
agcaaacttcaacaaggacaatgaggtcatataacaatatattggcaatgacacagtcggggcattcaaaatcccctttatttatcggtgataagaaaatcactctgtcatggatggagcagcccaacaaagcagcagctacgaaagcaggggggaagaggtcacaacctagtacaaatgggaatgaccctgcaaacaagaaggggagaggaggactgcaaaaccagctagcgaacagagctcttgaaggactgtctcatgttggaagaagcatgtgacgaggtttttgcatgagtagcctacgtggttttttt

SEQ ID NO: 81154 - DNA, 117 bp, Zea mays
  Clone ID: LIB3088-011-Q1-K1-E4
cggacgcgtgggcggacgcgtgggctcgtaacataattgcccggtccctgttctagttgtggcgcagtctggtttgttttgacatttgttttcaaggttcatccttatttgcattgc

SEQ ID NO: 81155 - DNA, 403 bp, Zea mays
  unsure at all n locations
  Clone ID: LIB3088-014-Q1-K1-G2
cccacgcgtccgcccacgcgtccgggagaaggagaaaatagatgcagagggcgtgagtgtcaagacagcatgcagcgggtacgaggatttgtgcagcgacgcggaacgcaagttcaaagaagtcttggctcagctgcggcggaagagcgccaggtgatgcacaagctttgggtatcgtttcgctgcttctaactctgacacctgtttatgctgtagggctgtagttttatctatgtatcgcagtgggctcagatcgatgtgctgtggttacttttgtgcaagccgttcggtatcgtttatgtatctgtaggtatccatctatggcttangaagcctgatgaagtctcgactctttataattgctactcctatataaattgccagctagttggaccgtacttaa

SEQ ID NO: 81156 - DNA, 200 bp, Zea mays
  Clone ID: LIB3088-014-Q1-K1-G3
ctgactcatacatccactcttaccaaagtctgagctaataaatgcaacttacgtgactatgaaggggcgattcatacaatacgatgatatgtacagctactcggaacgcaggcttaactaagccaccactaacatgccgctgaagaacgccatctgatacaaatgcaacatctctcacttcaatgctaataactatcaca

SEQ ID NO: 81157 - DNA, 402 bp, Zea mays
  unsure at all n locations
  Clone ID: LIB3088-014-Q1-K1-G5
atgaacttccttgtcaatggggtccgtgctctggtgttcggcttccatgtccatgtctgcctccttcgcacanaagtatacaagttggtgttgctagatctccccggcttgttgtttttctccacctacaccttgctcgtgctcttctgggcagaaatataccatcaggctaggagtctcccaacggacaagctaaggcctgcatacattgccgttaacgccatcatatacgttgttcagctttgcatatggatatacctcggaataaatgataatgccgcggttgagctggccagcaaaatattcgttgtagctgtctcctttgttgcgcttcttgggtttcagtatatggtggaaggttgtttgtcttgctgagacgtttccctattgaatctaaggggc

SEQ ID NO: 81158 - DNA, 345 bp, Zea mays
  Clone ID: LIB3088-014-Q1-K1-G6
tggcagcatgcgtgggagcaaagcgagcttcattctgaagtgcagcctcagcagctcggtggcaataacttcttccattccctcgatggtgctggtgaacccacccttcagatagggtatccttcagaggcactgactagctcatgcatgaccaccttcctgcccccgtggttgccatgagatcgaactactgcgcaattcctaattaatgagcatggccgcatgcagctgcctgtgctatacgtagtgcttggagtgtacttcaaggttcttgcatgacaagtatgtgtgttacatttgtgatggacatggaaactatccaattaattcttgaaaaatcaatga

SEQ ID NO: 81159 - DNA, 180 bp, Zea mays
  Clone ID: LIB3088-014-Q1-K1-G7
ggtcaaaactttaatgcagagtgtatatgtgtttcagggcaacgcgtggaaaagcggtgtgtgattgtatacttggtagtcagcccttaggaacaggtatgtgtttgtagcaagacttacgacgtgaaatgaggattctcttggggacattaatggtataacgtgcgaatgttagaacct

SEQ ID NO: 81160 - DNA, 297 bp, Zea mays
  Clone ID: LIB3088-014-Q1-K1-G8
cccacgcgtccgacaactccgagatcaagttcccgcttgtgtaccgcaaggtgaggccgtctaccaggaagctccggaccactttcaaggcttccaggcccaaccttttcatgtgagaggtatatcgtacccgtgttctgtgtcttgagcgcccgagagataaggattcttcctgtgcaagtttttggtgccctgttcgttgagcactttgtttgattccagttaaggatttgaatgatgctgtgtaaaacaatgacttgtctgcaattagttatcaactactgctatttacctgcc

SEQ ID NO: 81161 - DNA, 150 bp, Zea mays
  Clone ID: LIB3088-014-Q1-K1-G9
cccacgcgtccgcccacgcgtccgggatttggctgatagttagcgtgtgtatggcatggggctgaatcaaatgatgtgatcatcgcaaggtcacaaacagcctctttgtcatgtacatcgttttccatcatgctatagtgggtgtcagtt

SEQ ID NO: 81162 - DNA, 209 bp, Zea mays
  Clone ID: LIB3088-014-Q1-K1-H1
cccacgcgtccgcccacgcgtacgccgactcttgggctgacacgtgggagttcgcatagactaagtgtaatagacgggtgcgcttcgataaggcgtaaccatatgaacatatgtgcgataactgaaaccttacaggccactttgcatgagaatacgccttacatactgaaaaccccaactgctaaaagtgtgtgcacattgccaattat

SEQ ID NO: 81163 - DNA, 221 bp, Zea mays
  Clone ID: LIB3088-014-Q1-K1-H10
catcataatgcaattatctacaactgtttatttattaaaaacaatttgcctagcacagaaggcttttttacttgggaaggaatgattttttcatagtatccaaaccaagatcaattaaagtggataaattgattaacatttatagatacttccatgttattcacatcatcttaaccgttattttacattttgatgatcatcttcataatttgtatgccttt

SEQ ID NO: 81164 - DNA, 460 bp, Zea mays
  Clone ID: LIB3088-014-Q1-K1-H11
ggaagatggacctgttcatctattttattcgataagagccaatgcaagttctgctttagggttgtccctggatctgtcttctagaaacaagcagggtacttcaaaaattctggttgcagaggacatagcaacattcaccagaaagaaacaaaatcacaagtatggatcatatgttaaagccgataaggtggagctacacgctccagataaccacggttgggtcctttacaaagcaactgtttcttccagtgctgggcacacattaactggtatcaacattgtctgcacattgaaatttactggcgaaatcagtccagaatcagaagatgtcgatggaacttcactgtatcaggcatcactaggccacctcagtattcgaaatactgacaaaaatacagagttccctccagcagaatcttggataactgaaggaggatacatctcgtggtcaaaatgctct

SEQ ID NO: 81165 - DNA, 203 bp, Zea mays
  Clone ID: LIB3088-014-Q1-K1-H2
tagtaaaaaaaaaaaaaaaaaaaaaaaaaataaaaaaaaaaaaaaaaaaaaaaaaaaaaagaaaaaatataaaaaataaaaaaaacataaataaaaaaaaaaaaaatataatataaaataaccataaatttaatttatttcaacctatttttatactaactttttctacttttaaaacccttttatttccttaacttaatttc

SEQ ID NO: 81166 - DNA, 437 bp, Zea mays
  Clone ID: LIB3088-014-Q1-K1-H3
ggaccgattaacttggggaacccaggtgaattcaccatgctggaacttgctgagaatgtgaaggagttgattaacccagatataacagtgacgatgaccgagaacactcctgatgatccccgccagaggaagccggacatcaccaaggcaaaggaagttctagggtgggagcccaagatcgtcctgaaggacggcttggtgctcatggaggatgatttccgggagcgcctggccgtgcccaagaaaaccaaggcctaaactgccctgcggtgggcgaagaatatccacgggggagcatactcatagttggcttgtcattattcgtggccacatttcattacggaatttgagttccaataaacggaatataccttcttcgatcaccttgaaggattgtatcattagaattttcatacaaggctggccttttgagtctc

SEQ ID NO: 81167 - DNA, 385 bp, Zea mays
  unsure at all n locations
  Clone ID: LIB3088-014-Q1-K1-H4
ggaacgagcagaggaagactaggtccttctatgacatgcttgacaagggccagatcagcgttggcgtcgaggagtaaagagttcttcccagttattttcaaagaactctctcgagagcatgacaaagtgattgcttgctgtggagatttgtcctggaaataagcacaaccatttgagaacaccagattttgtcgaattttcctttccttttgatgaatatttgagcacgtccatgtcaataccaaacatctggccttttctctctctcttttttacatatgtttatgtggtcttagcaagtagttgtgctcgactntgcgttatgaggtatgccgtatgtgattggatcacggtgacctaacaggccaaaaaaaatagatcacct

SEQ ID NO: 81168 - DNA, 446 bp, Zea mays
  unsure at all n locations
  Clone ID: LIB3088-014-Q1-K1-H5
nncgccacgcgtncgcgaaatccctcgcatcgcattcgcagcctttgctgcatcacaccaccgcgaaaccccagcagncgcatcgatggcgcccaaggcggagaagaagccggctgcgaagaagccagcggaggaggagcccgctgccgcgaaagccccggcggtgaagaagcccaaggccgagaagcgcctcccggcggccaagtcgtccggcaaagaatgcggcgacaagaagggtaagaagaaggcgaagaagtcggtggagacctacaagatctacatcttcaaggtgctgaagcaggtccaccccgacatcggcatctcttccaaggccatgtccatcatgaactccttcatcaacgacatcttcgagaaagctcgccgcgaggctgccaagctngcgcgctacaacaagaagcccaccatcacctctcgggagattcaaa

SEQ ID NO: 81169 - DNA, 453 bp, Zea mays
  unsure at all n locations
  Clone ID: LIB3088-014-Q1-K1-H9
cttccaatgagccctctggagtctcttgcgtcatctgctgtgcgaactgccaacaagggcaaggccgcactgatcgtcgtcttgactcgcggtggcaccacggccaagctggtcgccaagtaccgccccagggttcccatcctctctgttgtggtacccgtgctaacgacggattctttcgactggaccatcagctccgagggcccagccaggcacagcctgatctatagaggcctcattcccctcctcgctgagggctccgcgaaggctacggattcagagtctacggaggtgatcctggaggctgcgctcaagtcggccgtgcagaagcagctttgcaagcctggtgatgccattgtggctctccatcgtatcggcgtcgccttncgtcatcaagatctgcatcgtgaagtgatcaccgtgacttgactnctaagtcccaaggggtgtttc

SEQ ID NO: 81170 - DNA, 372 bp, Zea mays
  Clone ID: LIB3088-019-Q1-K1-A3
tctgtccgtcctaccaccaccgctcacgtctttttggcttgctcccctcttccgcacccggttctcgctccggagtccgggtgccctctgctctttccctaacgaaggtagccatggcggggagaggtaaggcgatcggctcaggcgccgccaagaaggccacgtccaggagctccaaggctggcctccagttccccgtgggaaggatcgccaggttcctcaaggccggcaagtatgccgagagagtcggcgccggcgcccctgtctacctcgctgccgtgctcgagtatcttgctgctgaagttcttgagctggccggcaatgcggcacgtgacaacaagaagacccgcatcgtaccgcgccacattcagc

SEQ ID NO: 81171 - DNA, 372 bp, Zea mays
  Clone ID: LIB3088-014-Q1-K1-G12
agatcaaatgcaagagcatcaactgtttattgatgaaaaacaatgtgccgagcacagaaggctttttaacttgggaaggagtgatgtttgcaaggtatccaaaccaagatcagtgaaagtggagaaattgatgaacattgaaagatacttccatgttatgcacatcatctcaactgttaatggacagtttgatgatcatcttcagaatttggattcctttagagctgccttgcccgtttgaacagtcagttgtgcaccaaaagttgaatgccatggagttgattgataagtttgaagttacgaggcgaggaccatatactggttgtctaagatgaatatcgtttgattgttacatgcaaattgcactttctc

SEQ ID NO: 81172 - DNA, 320 bp, Zea mays
  Clone ID: LIB3088-019-Q1-K1-A4
acgccatggtctaggttaggctagggttcgagcatctagcggaaatggtggccttcaggttccgtcagtgccaggtgggggggcgcgcgctgccgacgcccggcgatgagcaccccaagatctaccgcatgaagctctgggccaccaacgaggtccgcgccaagagcaagttctggtacttcttgaggaagttgaagaaggttaagaagagcaacggccaggtcctggccatcaacgagatctttgagcgtaacccgacgacaatcaagaactacggcatctggctgcgctaccagagcagaaccggataccacaacatg

SEQ ID NO: 81173 - DNA, 238 bp, Zea mays
  Clone ID: LIB3088-014-Q1-K1-E12
acccactcatccgcacaaccttccgcagactcttaagcttatttattcctcatttaaacacctctacagtgagatcttttatcccgaacattgacaactacctattccaacactccacactgattataacacataatctacatttcaaagaccatccacatttttctaccacatataactcccaaatctatttaccatttatcaatcaatttaatccatatatacttctattcctatc

SEQ ID NO: 81174 - DNA, 444 bp, Zea mays
  unsure at all n locations
  Clone ID: LIB3088-014-Q1-K1-E3
cttctacgcgcctgacgtccaccacccccacaacgccaagccggcgctgctgcccgggtgcgacctcgacatgctcagggcgctgagcctcagctccccccgggccgccgccgcgccgtcgccgtcgccgttgctgcgcgcccagcagcagaggcacgcggacaggccggcgcaccacgccaggggcgccgcgcgccgcgtcatcatccaccagcctcgctagaagcagcctgatcatggcgggctgccgccatggctgttgtgcctagtgtaacctcaagcaagtctagtctgtttctgtctgtgtatacgactaataaaacaacagatgggggattcggacgaggcggtcagtgctctctcctcatagccagcttctcctgttcaagctcagttcttgttcatccagcagagcacataanaaaaacagacaggcagagtgat

SEQ ID NO: 81175 - DNA, 249 bp, Zea mays
  Clone ID: LIB3088-014-Q1-K1-E4
atcaaacaagatccgtttgacattttagcatattggaagaaccaaacagataagtatcgaattctttcccaaatagctcgtgacttaatgtctgttcaagtgtcaacagtagcatctgagtcagcatttagtgctggtggccgagtcattgatccatatcgtaatagacttgaccctgaggtggtggaagctctaatatgcaccaaggattggataaatgcacttagagaagattctaaaagcgttctt

SEQ ID NO: 81176 - DNA, 451 bp, Zea mays
  Clone ID: LIB3088-014-Q1-K1-E5
ggagcggcagactcgattcgtcctgctcgtcttcgccatcggggctctcctcgccagcgccgccgccgcggacttgtcggcggctgctggttccctgcacgcgctgccgctgcggcgcgtggaggacgacgacgcaagcagcttcgtggaggaggcggcgtacccgccgaggagggcgctgtacgggggcgggtccatcagctacggggcgctcaccgcgaacaaggccgtctgctacggctcgtgcgccgctcgtgggcaggcgtatacccgcggctgcctggccatctacgggtgccgaggtggccgttaattaaccagaagcagcgcgtagctagcagtcgatgtctgttaattacatgtctgtttcttgtgctgcttctcgtttttcttctaatccccttctcttgcttcaaacaagccaagatccgatccatatatacatgttgtc

SEQ ID NO: 81177 - DNA, 245 bp, Zea mays
  Clone ID: LIB3088-014-Q1-K1-E6
cggacgcgtgagcggacgcgtgggcggacgcgtgggcagacgcgagggtgtggatgttggcctgcactttgaagagcaatctatatgaaccacgaggcatgctgataaaaaaaaaaaaacaaaaaaaaacaccaacagaagaaacagaaaacgaaatccaaaacaccgaaagaatggaacattcaaaacgaaagaggacaacagctccaagaagcatgaggtgaaagactacattgaaacaaggg

SEQ ID NO: 81178 - DNA, 403 bp, Zea mays
  Clone ID: LIB3088-014-Q1-K1-E7
aaaaaaaaaaaaaaaaaaaaaaaaaaaaataaaaaaaaaaaaaaagccaaccaaagtaggtgttccatacttacttacccttccatacaaaaatgtcgcccattttttaggttcccctactttctattccctttgcccccctttttaacctttctttctggtaaacccctttcatttccctaaccttttttctttaccctctttttccttttaccctttggttcctcacgtaaaatccctttctaaaatacccttttttatcttgtctctttaattattaatgttccctcccttttttttttacaattatttcctccttctttttttttttcctcccccttttttgtttctcttttttctccctctataatttttttttttttatatatttccttcttttttt

SEQ ID NO: 81179 - DNA, 247 bp, Zea mays
  Clone ID: LIB3088-014-Q1-K1-E8
cccacgcgtccgcccacgcgtccggttcgagcagcaggtccgcgcggcgctgcccaaggaggtggaggccgcgcgcgcggtcgtggagagcggcagccccctggtccccaacaggatcagggagtgccggtcctacccgctgtaccggttcgtgcgcgaggaggtcggcaccgagtacctgaccggcgagaggaccaggtcccgctgcgaggagctcaacaaggtgctcgtggccatcaaccatttc

SEQ ID NO: 81180 - DNA, 458 bp, Zea mays
  Clone ID: LIB3088-014-Q1-K1-E9
gctggcggttcggagtgcatgtccgctatcgccggctcgtacggctacattgctcctgagtacgcctacacgctgaaggtggacgagaagagcgacgtgtacagcttcggcgtggtgctgctggagctcatcgccgggcgcaagcccgtcggggagttcggcgacggcgtggacatcgtgcactgggtgcggacggtgaccgggtcgagcaaggagggcgtgatgaagatcgccgacccacggctctcgacggtgcctctgtacgagctaacccacgtcttctacgtcgccatgctgtgcgtggcggagcagagcgtggagcggcccacgatgcgcgaggtcgtgcagatactggccgacatgcccggctcgacatccacgacgtccatagacgtgccccttgtcatcgagccgaatgaggaggactggggcccggagaaagagcagcagcagcagca

SEQ ID NO: 81181 - DNA, 214 bp, Zea mays
  Clone ID: LIB3088-014-Q1-K1-F1
tgcagcacctctagtacaaaataggttgccgggccagccatgccaaacaaccatggcagcatgctgtgaactagaggtgctgcatccttgtgttcctgtgccccatccaatgtgtatatctcatatttgtccgtgtcacatgaatgctctgttatttgtagctcaacagatacgtttttctccccctttctgatgtatgaagtttgatcttgcc

SEQ ID NO: 81182 - DNA, 455 bp, Zea mays
  Clone ID: LIB3088-014-Q1-K1-F11
gaaaagctattcacggtctccatccccacgtggtggacgtggccgcagccggagctacagcagaagccggagctatagccgatccagatccccatctggatctcccaggggtggacgccgtgaacgtgacgagaggagatcaaggagtcttagctacagcaggagcgcaagtcccaggcgttctgtctcacctgcaaaggaaaaggagcgcagtcgcacacccaatggcagtaggagccccagcccaagggctgaggtgagcccaccactgaaggataatggtgcacgcaatggctcagaccatgaaggcagccctggtggtggagagaacagcaagaggagtcggagcccatctgatggctaccgtagccctgtggccaatgggcgcagcccgagcccgagggacgatcggagcccaagccccaagggcaacaacgaagatgacgagcgccctg

SEQ ID NO: 81183 - DNA, 136 bp, Zea mays
  Clone ID: LIB3088-014-Q1-K1-F2
accacgcgtccgaaaaaaaaaaaaaaaaaaaaaataaaaaaaaaaaaaaaaaaaaaaaggaaaaggaaaaaaaaaaaaaaaaaaaataaaaataaaaaaaaaataaaaacaaaaaacataataaaaaaaaattaaa

SEQ ID NO: 81184 - DNA, 335 bp, Zea mays
  Clone ID: LIB3088-014-Q1-K1-F3
ggaattttgcatgagcacagtggtgcctttaagttttgccagtgagcatttgcaggtcgtaaatgggtggaatgaggcttctcctggcattagattgcaatgagattcctcagagacagctggattatggatgacttagaaactatatatagcagtgatcttgagcttcctgtgaggtgtgagctgaccaagtgagcaatcaccggtttaggctgtatgcccagcttcggtgcagagttttgtataatgttcaaatcccttttgttctttatgtttgtatttattttttaaatagtgctaattcccttaaaaaaaaaaatcttttttataaaaag

SEQ ID NO: 81185 - DNA, 294 bp, Zea mays
  Clone ID: LIB3088-014-Q1-K1-F4
attttgttgaggtgtaggctaattaatctttttttgttgaggcagtgatttatatgtagcggtcaccatttgattgttggatgctcacgatgtaatcgagcaattaaccgacattgttctggtacgaatgagagttataggagttgatcatttttttctctggttcagaattccacttgtatgattggatgagctccctgtttattatgaaaactaaaagagaatgatgtcattatgggatgaatcatgtgtatggcttggtaaaaaaaaaaaaaatataaattaatttaatat

SEQ ID NO: 81186 - DNA, 358 bp, Zea mays
  Clone ID: LIB3088-014-Q1-K1-F5
acgcccacgcgtccgggcagagctccctaagctgaaggaagaaaagccaggtctaacgctgcggcaatacaaagacatgatatggaaactgtggaagaagtcctcagacaaccctcttaaccaggctgctgactgaattttgcaaccctactgaatcttatgtgtaattaaaggccaaccttcaaacagcactggataggtgaattgtgttggtacctttttcttggagtggatgcgcactaaaccgtgcatcataaaggtgttccagtctcggctaataatttccaaatctctggagcgtatgctgaatgaagtgctcttgtttatgcaactgttggattgtttagtcactagactt

SEQ ID NO: 81187 - DNA, 295 bp, Zea mays
  Clone ID: LIB3088-014-Q1-K1-F6
gaacatttcagtagaaatgctactgttgtggtctcccatcgttgactttcatgagcgtggtggtaaacatcggttctgctcctgtcctgtattcatcggatgcaagtataacacatgcttggcttgggaggaggaagcacaaggagctattgccacctagcaaaaggataaaagggaggatgacgaattggcgatgtgtttgtgacacgctgccctcaagtgtggatgatgagtgcagatatgttggtgactgtgccaaggctgtcaagtgtgtaaactaacgctgtctttgtat

SEQ ID NO: 81188 - DNA, 144 bp, Zea mays
  Clone ID: LIB3088-014-Q1-K1-F7
aaaaaaaaaaaaaaaaaaaaaaaaaaaaattaaaaaacaaaaaataacaaaaccggtaaggttatataaggtacctaggcgaactaacacataccaacatagctatcaattttgttctaaagacaactaaatggagcttcacta

SEQ ID NO: 81189 - DNA, 371 bp, Zea mays
  unsure at all n locations
  Clone ID: LIB3088-014-Q1-K1-F8
gtcagggaatggagcacatagcagtgcttgctatgatgtgctcgtggatgttgctttggcgctgcagaaagagatgatggcgttccttgccaacacagagaagcacaaggacattgaggcttgcgacgaggtgatatctgcttcgatcaagaagatccatgagcaccgcaggaggagggcattcttcctgggtttcagccagtccccagtggagttcatcaatgcattgatagcttcccagagcaaggatttaaagctggtcgccggcgaggcgaatagaaacattgagaaggaaagacgtgccgacttctataaccaaccatgggtcgaagacgccgttataagatacttgaaccgcanaccagctaatg

SEQ ID NO: 81190 - DNA, 398 bp, Zea mays
  Clone ID: LIB3088-014-Q1-K1-F9
gccaggagtggggcacggctgctccgggtatatttgcatcacttaggaaggttactgatgggggttatgaagcttcggagtacctggcatagttctactgtgttccccataacgagagagaatattaaataacaccacaattgaagaaccaaatagtttcatatgccacgagctgaggacaaaatatttgcaagagttttcttgctgctttctactcctgtgcatgaggacaaataattgctgatctgttgagttttccatgtggagatgctttcaaggcatatttgctacatatgcaacattttgaacggacaacaattgtcagaccaattctatgtcgatcactttctgatgactgattgacagatattcatgtatgcatactatttacttttaaa

SEQ ID NO: 81191 - DNA, 117 bp, Zea mays
  Clone ID: LIB3088-014-Q1-K1-G1
gtgcttgtaatataacttgttttttcccccttcatttccagccccgatgtaacaggccattttggttttctaggtacttggtgactcatttctagcaatagggctgtcatgttgtac

SEQ ID NO: 81192 - DNA, 420 bp, Zea mays
  Clone ID: LIB3088-014-Q1-K1-E11
cccacgcgtccgcggacgcgtgggcgaacagctgctgtaattcgagaacttgaggatgggatagaaatccaaaacggtgacagctaccgattccaacaggcaaaattgagtataatacatgatctacttgggaaagtccatgcagctgttgttagcaccgagaaaggccaagtctatagagcattgctcaatgagttgaatgcagaaagacgtcaatgccgatctgggatgcgagatttgttcaatacctcttttggtgcaacatttcttacagacacgggaagggaatcatcattttcctatcacattcatcaatatgccgatatttacacgagcaagcttgagaactttttatcatatgcccctgaatcttggcttcatccacctcatgacataaagatcatgccacacaatgcgaaa

SEQ ID NO: 81193 - DNA, 302 bp, Zea mays
  Clone ID: LIB3088-014-Q1-K1-G11
ggcatgtgctcgctcacttaccaagtcctcttctggttatggttacttatggttctgtggaggggctatggcggcggctgatgtggagtaccgttgcttcctcggcaggcttgcctgggccaccagcaacgagtcgctggagaatgcctacgacttctacggcgagatcctcgactccaaggtcatcaccgaccgggagacggagaggtctcgcggattcggctacgttaccttctccttcgagaacttcatgctctacgctatcgagaacatgaactgcaaggagctcgacggtcgtaaca

SEQ ID NO: 81194 - DNA, 98 bp, Zea mays
  Clone ID: LIB3088-014-Q1-K1-B9
cggacgcgtgggctggaactcttttgtacctggtgccgaatagtcttttgtggatcaggcggtgacaaaattaaatggtgaccgttgtcttggggatt

SEQ ID NO: 81195 - DNA, 365 bp, Zea mays
  Clone ID: LIB3088-014-Q1-K1-C1
ggcaagaacattctggggtccatttcgcagtttctgatcatagtgttccagcacggctcatagtcataggcatatacggatatacaaaactcatactcaaaacctactgaatgaacttcccttcagctacagcaagcaactcaagacgcagcatatacaacgatggtggagcaccagcgcaatttcctgggcacccaccgttacatgcagaatagtttgcttgaaaggatggtgcacaaaatagtttgccattcctcctctctgaggttctgctaaaaagcatgttgcgtttgaagatcgtcggatttccagacgacgtcctttaagggcttggaaaggttcttgtagaacttatgaaattccag

SEQ ID NO: 81196 - DNA, 443 bp, Zea mays
  Clone ID: LIB3088-014-Q1-K1-C10
cggcaccaccggcgacgagcagacgcgcaggcgggagctcgccgccttcttcggccaggcgtgccacgaaaccaccggtggatgggcgactgctccggatggaccgtttgcctggggatactgccgggtgaaggaacagaaacagacggacccaccctactatggacgaggacccatacagctaactcataagtacaactacaggctcgccgggcaagcgctgaacctgaacctggtgggcgacccggacctggtggcgagagaccccgtggtagccttcaagacggccatctggttctggatgacgccgcagtcgcccaagccctcgtgccacgccgtgatgaccggcgactggaggcccttcgtcaccgaccgcgccgcggggaggctccccggatacgggctgaccacgaacatcatcaacggtggtctagagtgcggcg

SEQ ID NO: 81197 - DNA, 270 bp, Zea mays
  Clone ID: LIB3088-014-Q1-K1-C2
acgcattcctcccatctcccaagacctcctcagacccgagaagcgcagctgcggccatggacgccaccggcactggagctggagggaaggcgaagaagggagcggccggtcgcaaggccggcgggccgaggaagaagtcggtgacgaggtccgtgaaggccgggctccagttccccgtcggccgcatcgggcgctacctcaagaagggccgctacgcgcagcgcgtcggcagcggtgcccccgtctaccttgcggccgtcctggaatacc

SEQ ID NO: 81198 - DNA, 211 bp, Zea mays
  Clone ID: LIB3088-014-Q1-K1-C3
agaaactgcaccttcagaacctttcagatgacatctacaggggctatagatgtaagctgctgtatgtatttttgatatatttcactgatgaaatagtggattacagagttctaaaaatgatcttcttgggagatcacagcattggaaactgttggaaaaaatgtttaacaattcaatctatagttccaattgttgcctgtatagcaacaag

SEQ ID NO: 81199 - DNA, 165 bp, Zea mays
  Clone ID: LIB3088-014-Q1-K1-C4
tcgcggacgcgtgggaaaaaaaaaaaaaaaaaaaaaaataaaaaaaaaaaaaaaaaaaaaaaggaaaagaaaaaaaaaaaaaaaaaaaaaaaaaaaaaaaaaaaaaaaaaaaaaaaaaaaaaaaaaaaaaaaaaaaaaaaaaaaaaaaaataaaaaattaaataa

SEQ ID NO: 81200 - DNA, 76 bp, Zea mays
  Clone ID: LIB3088-014-Q1-K1-C6
tcggacgcatgtgccgacacctgctcagactcgtgaaccgacgcttcggaaaaggacaggaaaaaaaactatagat

SEQ ID NO: 81201 - DNA, 285 bp, Zea mays
  Clone ID: LIB3088-014-Q1-K1-C7
aggggctcgactgatgatatcagtgtcgtgatcgtgcagttgcagaaattttcaagctcgtaacctagttggagaagctggaacaaaactctagccagtagcactaacagactggtgataggtagacatgatatgttacttcgctggcgaaagttttcatgagtcagcgctatttggaggggattttaacattcattctttggtgtagagccattcgtcttattattacatcatttaattcattcttggtaagtactgaaataaggggtgatatctcgcttcatg

SEQ ID NO: 81202 - DNA, 437 bp, Zea mays
  unsure at all n locations
  Clone ID: LIB3088-014-Q1-K1-C8
cattcttctcttgcagacatgggcactctatgaggaagggcgtttagaagacatcatagatattgacatcggcgatgacctggatgttgatgaggcatgcaggttcatgaagattggcctgctatgcacacaagatgcaatggcgcgtcgtcccagcatgaccaatgtcgttcggatgctctcaggggagaagagaatcaacgtagaccagatcactaggcctgccatgatcactgattttgctgatctcaagatcagcaacaaggagcaaaaaccaggcgacacacgctctnccacgacaactgctacgacgaaatcattcaccaccaccgaaccattctcgtcgtcagagacgcccacgcagtcattcatgtgaaagtgtggcataagaagcagttttttttggtgtttcagtttgatagtgtgtgaatgtggta

SEQ ID NO: 81203 - DNA, 447 bp, Zea mays
  Clone ID: LIB3088-014-Q1-K1-C9
cggacgcgtgggggataatgaacgggaggtggtggggggagggggcaccgggacgtgtgtcgcttggacatgtgctagttgctacaaatttgtcgaactaattcacatcagcattttaaatcaatacatatcctctgtctctacctcatcttcagactcatcctcattcctctgaacgccgactgtctgaccctacaactctggaacatgctccaacaaagctctacgcctactactcgagctggaactagtgcccttaaacactaagtcctcctttctcataacataggcgctctcttcgcaagtcccttagtgaacttctagattttcagagagacacttagaattttgtggactaatatgactgttccaccaccatgagcgggattttcctgagtgcacctttctcttcatcttcaccaaaatataagaaaatcttctctgata

SEQ ID NO: 81204 - DNA, 327 bp, Zea mays
  Clone ID: LIB3088-014-Q1-K1-D1
tcgaaaaaaaaaaaaaaaaaaaaaaaaaaaaataaaaattaaaaaaaaaaaaaaaaaaaaaaagaaaaggaaaaaaaaaaaaaaaaaaaaaaaaaaaaaaaaaaaaaaaaaaaaaataaaaaaataaaaaaggggcggcccttttaagggacccaagtttccaaacccttccttgcaaattattattttttttttggtgtcccctaaattaaattaattggccgtctttttacaacttattacctggaaaaaccctgtctttcccaattttaatatccttggagaaaattccctttttgcaagttggcttaattccaaaaaggccct

SEQ ID NO: 81205 - DNA, 186 bp, Zea mays
  Clone ID: LIB3088-014-Q1-K1-D11
cccacgcgtccgaaaaaaaaaaaaaaaattaaaaaaaaaaaaaaaacataaaaaaaaaaggagcatataaaaaacaagaaaaaaaaaactaacaaacaaaagaaccaaaatctttataaaaacaaaaaaaaaacaaattaaattttcaacatcatactccttattctaatttaactaacaaaactt

SEQ ID NO: 81206 - DNA, 445 bp, Zea mays
  Clone ID: LIB3088-014-Q1-K1-D2
cttcgacatgaccgtcggcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacacctgccccggtgtgctctccatggccaacgccgggcccaacaccaacggctcccagttcttcatctgcaccgtcgcgaccccttggctcgacggcaagcacgtcgtctttggccaggtcgtcgagggcatggacgttgtcaaggccatcgagaaagtgggcacccgc

SEQ ID NO: 81207 - DNA, 351 bp, Zea mays
  Clone ID: LIB3088-014-Q1-K1-D3
caggtcattgcagcttaacgcctctgatggcttacgcaccttgaccgagcagatcaactgctactacctaacaaacggatccaactggtactgggtcacctactcttactaacgatggcctgccaagaacttaaactgtgcgtgactggttctattaatgcatagtgtaaattgtctggaccactaccaatatgttacccaagccttcacgttcgcttatacagcgtcaatctggatctccatgaccagtactagctagggagtgtgtgacatgtgcatgtgctctgtagactgttatggcctcttcctgttttcattgcatgcgctctttgtaccatgtaaagcctctga

SEQ ID NO: 81208 - DNA, 160 bp, Zea mays
  Clone ID: LIB3088-014-Q1-K1-D4
gcgttctgcttctgtgtttctccacagtgtagcttatttgttgccatgggaataaaatgccttgtactaaattgattgatggaagttgcatcaaaaaaaaaaaaaaaaaaaaaaaaaaaaaaaaaaaaacaaaaacaaaaaaaaaaaaaaaactaataat

SEQ ID NO: 81209 - DNA, 334 bp, Zea mays
  Clone ID: LIB3088-014-Q1-K1-D5
gcgcttgcttctaactgaatccagcctaccgctgatcgcacgtctacatggacgcgggctattctgacgagaaggcgctacgtgacttcgcaaggacagcgtccgcctcgacaagcgctgccagaagtcagaccgcacggagttgaccaaggttacggctcgtacggagatcgggttcgtctacatgggcttcatcggattcttcgggaagctcatcttgatttccatctacaacattaatagtcagttcctgctaggctcagggcgagacttgcatgggcgtagtacgatactatggagagcaacggatatccaggaacttgccctttggaat

SEQ ID NO: 81210 - DNA, 169 bp, Zea mays
  Clone ID: LIB3088-014-Q1-K1-D6
tttctttttcatttcattttcttttcccaaattcttcttttttcattttttatttttatcctttatatccctttttcttgacttttatctcttttttttttttccttttttttttttttccttttctcttttatattttttctattattttgtctctccttattttttt

SEQ ID NO: 81211 - DNA, 208 bp, Zea mays
  Clone ID: LIB3088-014-Q1-K1-B7
acgctttcttttacatctttatggggcgctgttcttgttcactacgccaccaacctcatagtgtccaggtcgaaagctcggatggttttgttactcacacttgtactaattttcatgcatctatggatcgacaatactcatactgtcaaccaactgaacccacttccctatcgtgctcaactagctactttatacccatccttttctt

SEQ ID NO: 81212 - DNA, 208 bp, Zea mays
  Clone ID: LIB3088-014-Q1-K1-D7
accgaattgcaatttcgacctagacgtacgcgtgcgcttacgcgttcgcggacgcaaggtgcgatttgaaccttaacctaacaagatcaacggctagggacaaactaaaacggagcgcaacggaattctgggtcacctactcttagcaacagttagcttggcaagatctttttccgtgcgtttactgtttcttcttatgcatcgtcta

SEQ ID NO: 81213 - DNA, 377 bp, Zea mays
  Clone ID: LIB3088-014-Q1-K1-D8
taccgattccaattgggggttgcctacgcgtccgaggaaaatgaacttgatgcctgttctccatctgaaaaagatcgcaaaaaacaggaatggcgcctgaggaggtgcgctcaacgccagatgtacagatgctaggatgtttgctctgcgtgagaaaagggtgcacgttacacaggaacacttctagatggccacagccaaggtgattaaaacagacacagcgaagaacatgtccctgcgcaagctctggaagtgaggctcatgccttgatgtacccaccgtcacctttgacggactcttcctgaacggtgtaacggcatgctacagaccttttgcgacgtgccttgcatgcctgtgtttaaaggtttgcttataac

SEQ ID NO: 81214 - DNA, 281 bp, Zea mays
  Clone ID: LIB3088-014-Q1-K1-D9
ccttgggatggacatgatgaccactctcatggtcatggacacgggcatgaggcatcatggtggtcatcttcacattgagttccttactggctgcggacgatgcttggcatgttccaacagctaaagtttgagttaataaattctatcaccctgcatgggactcatgttgtttgcaactggtttagcacgaactggtcttgttactattgtgctaatgtatttgtttcgaagtttcagttaatatgctgtggaaaagaatctggtgcacgttgatgttcttt

SEQ ID NO: 81215 - DNA, 259 bp, Zea mays
  Clone ID: LIB3088-003-Q1-K1-E11
gctggagaggatccacaatgcccggatcgctcgaaaggcgaacgggcatgctaacgtgcgagaaatggacatggagctggacacacacagggcggagcatggtccgaagactcggcgagttcctgaggagggcggttatgatgacgacgaagacgcacaggacatggctgcggaagacgaggtgatggatgaagttctgggcatcaacgatgggatcaacgaggacccatccaagccgtccgaagaagctactactgaa

SEQ ID NO: 81216 - DNA, 392 bp, Zea mays
  unsure at all n locations
  Clone ID: LIB3088-003-Q1-K1-E12
agagcgtctagacgtacaagatctacatcttcaaggtgctcaagcaggtgcacccgggcgagtggtatctcgtccaaggccatgtccatcatgaactccttcatcaacgatatcttcgagaagctggctgccgaggccgccaagctcgcccgctacaacaagaagcccaccataacctcccgggagatccagacttcggtgcgcctcgtccttcctggcgagctcgccaagcacgccgtctccgagggcaccaaggccgttaccaagtttacttcctcttagatcgccgccgcacggagcgacggctctgtttcgtttcctcgtacttttaggccagtgctaataggtngctcgaggaacaatgtagtgtggaaatttctaatatattccaa

SEQ ID NO: 81217 - DNA, 129 bp, Zea mays
  Clone ID: LIB3088-003-Q1-K1-E2
ccaaggctttctcccacccttccattcattcacctttaattaatttgtttgggggttccgggggggggttgatcatttctggaaccaaaactttggccccaactcggttcgtgtcgtgaataaaatcct

SEQ ID NO: 81218 - DNA, 321 bp, Zea mays
  Clone ID: LIB3088-003-Q1-K1-E5
gtcaccatgaagctttactagacagaacattagcgaaacctggcattcatcctgttaatggccgtcagaggtgttgcccaggaatacagcttggaagccggcaaaaatttgtgattttggtgcttctactgtcatttgttgttatgcttgcctttgccatcctcatatgggttggtagaggagacaatcctatcgattcttctctactgaaaagggtttatttggatgtattttcagtagtagttattgtacttggtggtgctctggcatgttacggtgcactgttattctcgaagatgagcaaagttcgttctgaaactg

SEQ ID NO: 81219 - DNA, 219 bp, Zea mays
  unsure at all n locations
  Clone ID: LIB3088-003-Q1-K1-E6
attagctagaaaaagaatgccgatcatgcttcacataagccattagatgcctaacctcggggagggccaggaggcttcttccaaaaggaaaaaacctaggcgtgcaccacccggtttctaactattctttcaatatatactgagtactgactcgtacaatatagctttttactgtctttttgcnncaaaaaaataaaattataaaaaaataaaaggggg

SEQ ID NO: 81220 - DNA, 89 bp, Zea mays
  Clone ID: LIB3088-003-Q1-K1-E7
gccagcctttcgttgcaatcttcgcaggtttacagcaacacaatccatgatctcggggtagttatcatgtactctcaaaacaaacaaaa

SEQ ID NO: 81221 - DNA, 397 bp, Zea mays
  unsure at all n locations
  Clone ID: LIB3088-003-Q1-K1-E8
acgctcatcttgttccgtgttcctgtatccgttgtttccgcgcctgttggtccgctggggacgccggatttttgcatcgagcacggaaatctacaacaaaaacatggagctacgacgcgactcccaaggtacaatcggtaattatgttcaaacaatttttaagtcgttctgcgctccttctattacgagcaacgttttatattctgtgcttgcataatgaatcgaagaaatcctgacaccaatcgaactgaagatcctgaaacgcacgttaataccgttgacgtccgcttcacccagctcgattntcagtcttgtaatactaatcgctccatgagtctgaagtgtgcaaaaatttatgtcgcagctacacaaatttacatgctggttctgttcaacc

SEQ ID NO: 81222 - DNA, 62 bp, Zea mays
  Clone ID: LIB3088-003-Q1-K1-E9
cgaattgaatttccagactagacccacgcgtacgcgtagaggttggctgatatcggggtttc

SEQ ID NO: 81223 - DNA, 343 bp, Zea mays
  unsure at all n locations
  Clone ID: LIB3088-003-Q1-K1-F1
cttttccaactaactccaaatcttnttttcctgctacaccctggtcccgaaaataactgtctcgagaatgatgccaacgtgtacctttcattttggcttgaccatctcctcctctctctgcaacaagcttcctcactaaacccgactccatgcttcacacacaaaactttgaatgagatacaaactntcgcgatccccaatccatttgatccctcctttcccatactaatatcagctaggatgcaagattgttactctcgtcactgacaagaacattggccttttctttcgatatgcattcaccattatgttcaaaaaagttctaagcaagtcccacagttct

SEQ ID NO: 81224 - DNA, 449 bp, Zea mays
  unsure at all n locations
  Clone ID: LIB3088-003-Q1-K1-F11
cggacgcgtgggcggacgcgtgggaggaagttggcataccggacactgacatccaggcggagtcttcaagcggagatgaggagactgggaataaaactgtgacgacagaacaacaaagtgcagctggggctggctctatgaagttccatttctcgtgcactttatagaggtacccgttgctctgagtgctggtaatcgacttacctggtttcggcaggcaggcatacacgggcaccgcaccgactaatcacaagaggcagtggaacaactttctcctcgagagttcatttttctttgttctgagggcggcagttgaaagcctggacaacactagcaattcatttatttgtaatgatcctagcatagcagatgttgttacctacccaatgcagcgtttgtaaattttttgctgtaaaaatatcaaaggcagaanaaagtactttcgcagt

SEQ ID NO: 81225 - DNA, 222 bp, Zea mays
  Clone ID: LIB3088-003-Q1-K1-F12
tctgcttttacactctgattctctcctactttttttagtccttggtactgttttaacgcacatatattgatcagacatgtatgtaaatattacttcttgctcgctgtcaaaaaaaaaaaaaaaaaaaaaaaaaaaaaaaaaaaaaaaaaaaaaaaaaaaaaaaaaaaaaaaaaaaaaaaaaaatgaaagctaaaaaatgaactaacctagtaatggaaaaga

SEQ ID NO: 81226 - DNA, 438 bp, Zea mays
  Clone ID: LIB3088-003-Q1-K1-F3
gaaaagtactgcatcatatatattgtttttatcatatttccataattaaaataaaatattgcctaatattgcgattttgttgttgaacattccttgtttgtttatgacagcacaaaagcacaaaattcagtgaaatgtatgatggacttcgttaattgtcagcagtgcatgtttctattttagttcaactccatttatgttgttaatgagtggctctgaagtgttccttttccatatcttttctggcaaagacgcagttatcacagatggaaaatatttaatactacgactgctacagaggaaacaagatacctgtactgatggaatatgattcgtgtattattccttgggaacttgaacttatcatatggagttgtaaatttttttgtcatttcgacttatgttcacttcatcattgcctttatgatcatgtaattc

SEQ ID NO: 81227 - DNA, 216 bp, Zea mays
  Clone ID: LIB3088-003-Q1-K1-F6
gccacgcgtcccgttattttaggttttaaattaagtttttttcggaacttcaattttccaatgctaaattttttctcaaaaaaaaaaaacccttggttttgtaaaaggaaatggccggtcttttaaaaaaaaaaaatcattattgaaagaattttaaaaactttaaaattatggaaattaaaaccctggacattcttagaggttaaaatttgcctt

SEQ ID NO: 81228 - DNA, 279 bp, Zea mays
  Clone ID: LIB3088-003-Q1-K1-F7
ggggggcgcggcaagggcggcaaaggtctcggcaaaggcggtgccaaacgccaccgcaaggtgctgcgcgacaatattcaaggcatcaccaagcccgcgatcccgatgcttgctatgatgggccgcgtcaagcgcatctccgggctcatctaccaagagacccgcggtgtgctcaagatctttctggagaacgtcattcgtgacgccatcacctacaccgagcacgccccgcgcaagaccgtcaccgtcatggatgtcgtctacgcgctcaagcgacag

SEQ ID NO: 81229 - DNA, 230 bp, Zea mays
  Clone ID: LIB3088-003-Q1-K1-G1
agcaaagcatttactagaaggataaaggttttaggatcatagatgatgggaaggacgtgctgtagattctccttttttccttgggtttcatcagtcagtgtataagtactaatgtccatgctgatgttaatctctgtaagactgccttcagtttactgattcaaaaaaaaaaaaaaaatataaaaaaaaaaacataaatataaaaaatggatggattataaaaggtaact

SEQ ID NO: 81230 - DNA, 111 bp, Zea mays
  Clone ID: LIB3088-003-Q1-K1-G11
ggggcgcgttctcccactcttccgcttactcttattctccagcacaacctacatcggaagctcttactttttatcatcatctaccctcactaccaacaatccacatcaaat

SEQ ID NO: 81231 - DNA, 162 bp, Zea mays
  unsure at all n locations
  Clone ID: LIB3088-003-Q1-K1-G2
gcaaaatgcaattgacctgagcactgttgatgtcagctatgttagtagccgggcagggtagttcctcaatttattcancttgaggggtcttttcagtctgatcctgggtgaagaaaacgcacctgatgatgcccagaaaatgatccaaatgggtgggggttt

SEQ ID NO: 81232 - DNA, 57 bp, Zea mays
  Clone ID: LIB3088-003-Q1-K1-G4
gccacgccttcctccaattatttcttgaacttctttttttccccttggaatctccca

SEQ ID NO: 81233 - DNA, 406 bp, Zea mays
  Clone ID: LIB3088-003-Q1-K1-E10
ccatctctctgatgaactcgaaccaaagctggaggatgcttagaacggggagacgggtgggggataagtcaaagttagcagcatcgtgatgccaactgccccctatcatggttttattggccctctgcttgtttctcatttccctttggagccagtttctctgttttgcgaggtcacacaagccttatttgtagtattacaacacagaagctggctgacccaaaatccgacactctgggtgcagcaacttaacaaaatgtttgtacgagggtttagagccccacggtgcttctttggataagtatgtctattaccttgtacttagctaggaacctgcttatatgcaagatctttgcgtacgacggagaattgtcacagcggcataattctggtgcatcttggattt

SEQ ID NO: 81234 - DNA, 142 bp, Zea mays
  Clone ID: LIB3088-003-Q1-K1-G5
gcgggcctggggctttgttttgtgggaattattgaccaataaaatgccatttgaaggcatgtggggtggggagccggatttgcctgttgttttcaacaaaaggcgccaacttttccttgagagaacccccaagaacctgggg

SEQ ID NO: 81235 - DNA, 206 bp, Zea mays
  unsure at all n locations
  Clone ID: LIB3088-003-Q1-K1-G6
aacccacccaccacccacgcgtactgnaatttntttttnnaaattatttttcatttttattccattttaanncctnncagagcggctaacttctttttcttcctccccccaaccaaaacccccaacttttccttaagaaaccccccaagaacctttgttcattatacaatcaatcttggttgaagatccttccattccaaccaatt

SEQ ID NO: 81236 - DNA, 61 bp, Zea mays
  Clone ID: LIB3088-003-Q1-K1-G8
agccttccggcaagtcttgatacaaccatgcatccaaccgttcatgtttgctatggaaaac

SEQ ID NO: 81237 - DNA, 148 bp, Zea mays
  Clone ID: LIB3088-003-Q1-K1-G9
ccgattccggtcgacccaccgtcgggacgctggcctctacctccttccctctttctttgttataccgggggggccagggggccttgggattgcctggccttaaaggccccttagccgttaattcggtttgaaggggaaggtcgccaaa

SEQ ID NO: 81238 - DNA, 345 bp, Zea mays
  Clone ID: LIB3088-003-Q1-K1-H1
cccacgcgtccgcccacgcgtccgatgcgagaatactgccgcactttgtgataatgggagggcaaacattgaatgcaagctgaaccatactattgacaagccagaagaggctaccattatagagatgcaggagccggtttccctgacctttgccctgcggtacatgaactccttcaccaaggcgtcttcactgtctgagcaagtcactatcagcctgtcgtccgagcttccagtggtggtcgagtacaagatcgctgagatgggttacattagattttacctggcccccaagatcgacgatgacgaggagatgaagccctgatggcctgtgacgacataatgctc

SEQ ID NO: 81239 - DNA, 398 bp, Zea mays
  unsure at all n locations
  Clone ID: LIB3088-003-Q1-K1-H10
agccangcggacgcgtccgtgggtgtaccgggagggtcggcacaggacatcacggcagagcggccaccgcagcggcttgagagcgtcaccgttcgtgctggcgttgccgtcgactccatcgagttcacctatactgacagcgctgggcagaggcgcgccgctgggcgttggggtggacttggcggcaatgttcgaacgatcgaccttggcaacgccgaggatgtcagggaagtctcgggaacatacggcgcatttgaaggtgccactacgctgacctcgctcaggctcgtcaccagcagcagaacctggggcccctggggggtcgagaacgggacgcgtttcttcgtcacggcgcccatcggcagcagcatcgtgggattctatgcgcgggcgggaac

SEQ ID NO: 81240 - DNA, 64 bp, Zea mays
  unsure at all n locations
  Clone ID: LIB3088-003-Q1-K1-H11
ggggnnggnnnnnnnngacgcgtgggcggacgcgtggggttctagatcgcgagcgggcgctggg

SEQ ID NO: 81241 - DNA, 164 bp, Zea mays
  Clone ID: LIB3088-003-Q1-K1-H12
accccccccccccccaccaaaagaaagaaagagatcttggaattgatccagggtacaaattttgttgtgctggcaagatacatgcaaatcctctcagaaaacctgttaaaagcatatggtaaagacattatcaatattcatcatggccttcttccctcatttaa

SEQ ID NO: 81242 - DNA, 88 bp, Zea mays
  Clone ID: LIB3088-003-Q1-K1-H3
cggggaccttcttacccccctaagcttaaccaagtccttcaccttcattggccccaaggagggggaggaggccaccacctccttccat

SEQ ID NO: 81243 - DNA, 348 bp, Zea mays
  unsure at all n locations
  Clone ID: LIB3088-003-Q1-K1-B7
ccggcacgcgcagcgcgtgggcactggcgcccccgtctacctcgccgccgtcctggagtgggtcgccgccgaggttctggagttggcagggaacgcggcgaaagacaacaagaagacgcgcatcatcccgcgccacgtgctcctggcgatccgcaccgacgaggagctcgggaagctgctggcaggcgtcaccatcgcgcacggcggcgtcctccccaacatccactccgtgctcctgcccaagaaggcggcggagaatgcggncagcgccggcagcaaggagcccaagtcccccaagaagggcgccaagtcccncaagaaggcttagaaagtagggacttcatttgc

SEQ ID NO: 81244 - DNA, 459 bp, Zea mays
  Clone ID: LIB3088-003-Q1-K1-B8
cgcctgttgccgtcccaaaccgccaccacgttccaagccacaagctaccctctggtcggcgcgctgagcggtctggacgagagcaccatcgcctcgctgcccaagacgcagagggagcccctctccttcttcgggagcgacttcgtgaccccgaagcaggagaaccagacgctgcgccccttcttcgacgagtggcccaagtcgagggactcgtggccggagctgaacgaggacaacagcctcggctcctcggccacccagctctccatctccatccccatggcgccctccgacttcaacaccagctccagatcgccgaatggaataccgtcaagatgaacctgagtaaccatgcggaccccaacatctcagagctgacgactctttgctgctggcctggcctcatcgtaccttgaggcgtcaaggaatacttcattaccactagtatcatgctcctgg

SEQ ID NO: 81245 - DNA, 107 bp, Zea mays
  Clone ID: LIB3088-003-Q1-K1-B9
gctagctcttgttgttgttttgcatgtttgattgggtgtcccttcccagtcgagatggaggaatgtcaggcgcacgtacagacgtgttattacgatatttctcccct

SEQ ID NO: 81246 - DNA, 411 bp, Zea mays
  unsure at all n locations
  Clone ID: LIB3088-003-Q1-K1-C10
cccactcttccgcaaccgccggccgattctagcagcgccccagcagcctctggcgggcgggggagcccgaggaggaggaggagggaagatctcgctcgatccaaggaggtgagtacaagatggtgagctcctcgtcgccggtggtcaacgtgtacccgctcgccaactacacgttcggcaccaaggagcccaagatggagaaggacacctccgtcgccgaccgcctcgcccgtatgaaggtcaactacatgaaagaaggaatgcgtacaagtgttgaagcaatcctattggtgcaagagcacaaccatgctcacatactgctcctgcaaatcggtaatacattctgcaaacttcctggtggacggttgaagcctggagaaaatgaaattganggtttgaaaagaaagtatg

SEQ ID NO: 81247 - DNA, 218 bp, Zea mays
  Clone ID: LIB3088-003-Q1-K1-C11
cccactcgtccgcccacgcgtccggttaacttacagcagaatcaccatggagaggaggcgcgtggaatttataatgctttgtagtgtcttgttgactactttctaagaaactggtccgcacgactcgcataagactttcaatgggaatgaggaatgatgtcgtgtgctcactgctgaaagttaaccggacgcgttggcggacgcgtggtcgggcgcgt

SEQ ID NO: 81248 - DNA, 71 bp, Zea mays
  Clone ID: LIB3088-003-Q1-K1-C2
aaccgccatttccgaccaagccgtccgccgactccgagtattaccttaaggaggcctttatctttttcacc

SEQ ID NO: 81249 - DNA, 381 bp, Zea mays
  Clone ID: LIB3088-003-Q1-K1-C3
cggaatgaccgtaggagattaattctgctttaacattctctgacaagagcacatgaggacgctcggaggctgctttgcattgtcttttcacatactacatgtctcagattcgatcgatcaagttctgccccgtcgaaaaaaatactagctgttgctactttacagggctttgtctcagcgtattggtcgttgctgatatgcaggctcttgagcatggcggccatgatttcttgatcatcttggatgttactagctgatcggcgttccaatgacgttgtctttgcagaacgatctttttctcttaaatgacgaacaacctccacactaagctttttctgtgccatcatggacggaccacaagactgtaccgttcaaagcttt

SEQ ID NO: 81250 - DNA, 60 bp, Zea mays
  Clone ID: LIB3088-003-Q1-K1-C4
cgaggatcaacgtccacttgtaccagatcactattcctgccgttgcagcgcggcgggttc

SEQ ID NO: 81251 - DNA, 133 bp, Zea mays
  Clone ID: LIB3088-003-Q1-K1-C5
ggggaagatgagtcgctttattcaatggtcgttcgttgccggttactctgaaactaataaggcggaggatttggtcattacctaacggatgtccttccgaccttaaattttattggtacaggtaccccccctt

SEQ ID NO: 81252 - DNA, 390 bp, Zea mays
  unsure at all n locations
  Clone ID: LIB3088-003-Q1-K1-C7
cccactcatcctcccacgcgtacgcggactcttgggttccggaatccaatctgtggggtagatgcaatcgggtgtggaatcaccctggttgatcgcactttctatggctacgtgaggcatctgatctcgcagcggaaggctgcagccccagggagtctaggaacagcgcaagcaaggaatcagacggagatgcttccccttgttgtggacgagaagcacgaaaaggtttagcaatggtgctaggccttctcttcacttgttgaagagagaattatatatgtactcgtgcgtgcntgtgtggcgagggtagcaaactggaacttcgtacaagcatcttttcctccttccatttgtgacactattcgccagcatcagaatgtgaaattgaat

SEQ ID NO: 81253 - DNA, 364 bp, Zea mays
  unsure at all n locations
  Clone ID: LIB3088-003-Q1-K1-C8
aaccnccagtcccgacccgaccgacgcgtgcgtcagatcacacacatttctcgtcatgaaaccctttcaagattacctgtgcgcctggcaacgaatcgcattattgaacttgttcaactccggaccatcactaggcctgtgatattggcaggttcaaaagcttctgttactcggccattgcaaaaagctgaaaggtttcggactgaactgctcaaacgaggcgttcttctaattcctgtgatctttggggcttctcagaaggaccaaaccaaaccaaggggttttggtgcaagaagagcttctgcatcagttccttctgttgggggtgactttgaaaaacgtactgattctattgcagcaaaat

SEQ ID NO: 81254 - DNA, 275 bp, Zea mays
  unsure at all n locations
  Clone ID: LIB3088-003-Q1-K1-C9
cccacgcgtccgaacatcagtatcgaatccacagttcatgcacaccttggggaagaaaagagagagaagagatccgtgctctacgttgcaagtctaattgatatcctgccgagtattcttcgagaggcccattaaaaaaaagtattcttcgaggcttgtgcacttctgtcactgttttgtaccccgtgtttaatttctgggcggtatgatatcaagagtacccagatgtatccgtcgttgctggtctaaacactaatggggtgtttggcctgnat

SEQ ID NO: 81255 - DNA, 343 bp, Zea mays
  Clone ID: LIB3088-003-Q1-K1-D10
gaaaacccggcccgacgcgacgcgtgcgcgtggactggtccttcttgtgagtgttgatcggccccctagcatacccagccagaaaaggatcgctattcacgcctatcatttccccctactattcagttgaactctagctccaagtactggacgctctcgcctttgtccaggcaatcctgtgaaacgcacatgccccccagctcatccgtggaacaaacgccttttgtagttcaaataatgataactagggtgcaagatgcaaaggaaactaactaaaaaatgctgtacgaaaagacatgacgttccttcaaagaaacaattttaaactacacaaccggggggg

SEQ ID NO: 81256 - DNA, 375 bp, Zea mays
  Clone ID: LIB3088-003-Q1-K1-D11
cggagcgtgggttccattgtagtttcacatgatactgtctgtagaatctaagcatgggctgtgaatgtgggtgaactgattcttgtttcgtttgattgcagtggaagaagaagaggatgcggaggctcaagaggaagcgccggaaaatgaggcagagatctaagtaggcgcatcttgtgacgaggatggcgagcttctcctgcatcatggctgaggctcgttgggatgatggtctccctttgcagacgtcctttgctgtagacgtaggcgatgtaaaccgtcctttttgattcattctagcatgttctgagactgggtttatattgtaatttgaggataattatatgatgctctaagttaaatcagatttctggc

SEQ ID NO: 81257 - DNA, 379 bp, Zea mays
  Clone ID: LIB3088-003-Q1-K1-D12
ctgtgccaacacctcccgctcgccccaacgtccggcaatcgtcgacgacctatgaggctgatggcacctcgtccatgttctcttcgggccccttctcaggcctcagccccttcgagaccgaaaccattccaaggactgcggttttctcagaagatctccatgaaggtcgatgactggtggggggtggctgccttgccatcgccgagccgagccgtttctctagagcctgtagccatgtagtcaagcattcaaaggctggtggtccaattggcctggccagccattgggaggaaaggggtacctgtaaaattccattttctgcgccgtctcaaaagactactactagattattacaacccacaaggacgttctctggctt

SEQ ID NO: 81258 - DNA, 343 bp, Zea mays
  unsure at all n locations
  Clone ID: LIB3088-003-Q1-K1-D4
gcgccgtgttccgtgtcctcgtccagtgtgtcctctactccgctccccctaantcctcaattggtaggctagcgttaccttccccccggaaaacgtaattggcggtttcgaaggcggcagcggcggcggcaacaccggtgacgccgacagaggggacggtgatcgcgatccacagcctggaggagtggagcatccagatcgaggaggccaacagcgccaagaagctggtggtgattgacttcactgcaacatggtgtcctccgtgccgcgccatggctccaatttttgctgatatggccaagaagtccccaaatgttgtcttctgaaagtgatgtcgatgaaa

SEQ ID NO: 81259 - DNA, 95 bp, Zea mays
  Clone ID: LIB3088-003-Q1-K1-D5
aaaaaaaaaaaaaaaatataaaaaaaaaaattttttttaaaacacaaaatggcccccaattagaaggttttttttttatttccccctcccaccca

SEQ ID NO: 81260 - DNA, 286 bp, Zea mays
  Clone ID: LIB3088-003-Q1-K1-B6
gtcgcgagcggccccttttttttttttttttctcaagattacacaatgtaaattattggcggaatgatgtaaatgatagtggcgacaaatccctttcaactacaaaagtaccgcctgcttcataccaccaaagaatttataaaaggaacctgctgctgaattaatccctcttccctctcaaaaagagctatatctatgggggggcctaggctggacccaatcatactttcttttcacttcagcagggaagtgaatgcacccccagggactcccatctacttggccg

SEQ ID NO: 81261 - DNA, 206 bp, Zea mays
  unsure at all n locations
  Clone ID: LIB3088-003-Q1-K1-D6
tcccaccccttccatttattaaaaaaaaaaatttatttaaaaaaaaaaaaaaaaannannaaagaaagattttttaaattaaaaaaccnncccccccccctaaaaaactccgntttacctatcaaaaaatcccacctcctttccccccacaaaaaaaaccggggtcccttttaaaaaaaccaaatttccaaccccttccccccaaa

SEQ ID NO: 81262 - DNA, 239 bp, Zea mays
  Clone ID: LIB3088-003-Q1-K1-D7
caaatcactcccaccgtctccacagcttccttcacacatttccctttggcggatcgaggggaggaaggaaggaggagatggctcgcggcatggaggtgcacaaaaaccggtggatcgaagagtggaacgccggccgcgagaacctcgagttcaatttccgctggacccgccgcagcctcgccgtcgtcggccttttcggcctcgctgtccccatcctggtctacaagggcatcgtccgc

SEQ ID NO: 81263 - DNA, 196 bp, Zea mays
  Clone ID: LIB3088-003-Q1-K1-D8
cccactcgtccgcccacgcgtccggtaaatggccgtgggcgacgatggaatgtgagggggggaacacgagatcctggtgtcctcttgctcgtccagatcttcaaccaccagctaaccatccttttttttagtgtagccagtaattgttattccgacacgttctttgttttgtaatacgactaatctctgttgtgat

SEQ ID NO: 81264 - DNA, 421 bp, Zea mays
  Clone ID: LIB3088-003-Q1-K1-D9
cccacgcgtccggattttggctgacaaagagcgctgtctgaggtgcgtggtcaagtggaggcgaagatgagcaaggaggatgtgctcaaggtgcagatctctgaagccaattacgtacacattttcctaccacgacttttattctgctttccgtttctcaacgtcttggacattgccggcgagcgcggtctcctcgacaacttctactgctaactcgggtgcaagatgcccagcaaacttcccaatccagctgccggcaaggagatgaggttcccgacggcgacaattttccactacacaaccggattcttcagcagcatatggatccgttgaagcgccgtgtgacaatgccaccaaagagcagcaacaaacaagctcaaagtctccgctaaccactaatctcataaaagctgaattttct

SEQ ID NO: 81265 - DNA, 364 bp, Zea mays
  Clone ID: LIB3088-003-Q1-K1-E1
cccacgcgtccgcccacgcgtccgcccacgcgtccgcccacgcgtccgggaacaggagagcgatggaaataatggacattagaaacagagacatgttcctcgagagcatcatgtgatttattttgttgtaaatcactaccgatgcagctcggtttgcctactgtttcatctacactttctcttcctttttccttgatgttataggattaacatcactgggtgactttctggaattgcatcgatggttccttttggtgagaaaaggtcttgctgctggtcaagaatgtaacttgtagagcatgatgttgaatcgtgtgaaattagttcagtacttttgatctaacaaatagaaggtcgaattggg

SEQ ID NO: 81266 - DNA, 277 bp, Zea mays
  Clone ID: LIB3088-002-Q1-K1-H3
ccgacgcgtccatgaatgaacacgcgcgatcgcatgacatgacctaccacagctgctaagtgcttgcaatctggtaagccacactataacagttaataacgtaggtgtgattggcctcaactgtgtctctatagttctgaacctacctgatgtagccatcactgtccttgcgccgattaacatgctctctctgttcgatcatgacgaagacgttgacactgtatgcatactcaatggtactggtcgagccaatcaccgaaatgctgacgaggccact

SEQ ID NO: 81267 - DNA, 345 bp, Zea mays
  Clone ID: LIB3088-002-Q1-K1-H4
agatggtgctctaaacttacgtaaaggaaatacgaagcatagaagagtgcccaagttgtgttatgtatttttttcattccttgatcttggatcaaagattcaaggcaaagtcagcctggtgcaaaggttttggttgaatccttgtatcctgccagataaggttttttgatggtgcaattttggattagcatttgccctagtatttagtgttttttagttctgtattcatttatgatgtaatacaactttgtgagcatagttctgtttggcctgctttgttcaatcgcagtgcgggttcaatactacgttgcctgatgttattgtctgttattttctttgtaaaaa

SEQ ID NO: 81268 - DNA, 293 bp, Zea mays
  Clone ID: LIB3088-002-Q1-K1-H5
agcatcatcaccatccgccggcggcacggccacggcgggagcagcccgcggtggtgtccggcatcgggtgccgcagcggccggttctcgccgtccgcggcgaggcgcgccgccgagagcgccgtgcggcggacgcactccgccagggaggccgacatggcgctgccgtcgtcgaagcggtcgctctccctcaacgccgctgctgtcaacggcaacgggggaggcagcgcgctctccaggcgggaccctggcgagcggtccggccggcgggcggactccccgacgggcaggcgc

SEQ ID NO: 81269 - DNA, 445 bp, Zea mays
  unsure at all n locations
  Clone ID: LIB3088-002-Q1-K1-H6
cacacgatcaaacatgtggcagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactntgctgtcgacattggcaggaatgtcattcatggaagtgacagcattgagagtgctaataaggagattgccctgtggttccccgagggc

SEQ ID NO: 81270 - DNA, 275 bp, Zea mays
  Clone ID: LIB3088-002-Q1-K1-H7
acgatacgttttatgagttttctgttatttcctcagtggcctaagctagcaacagtgtatagttgggttgacactcaaacttctaccattcgagttgggtattagaactagttattattggttcatgttgaacttatatatatttccatccttttgcagttagtttgagtcatatttgctgtgtaccaaacatgtattgcaaatttggaatttttgtaagctataataaggccagcacggcaatatccccacatgataaccccgaaatttgtatc

SEQ ID NO: 81271 - DNA, 453 bp, Zea mays
  unsure at all n locations
  Clone ID: LIB3088-002-Q1-K1-H8
acagaattgagaaaaccagtgaaacatctcataaacgcactggaaagcataggaccagtggcgtttggtgggaaatggggagagaaactggatgctgctttagttacagacatgggtcgttatagaaaatataactttgagtctactcgtgatcttctgaggtatatcagaaataaatcgggtcattacagagaactttcaaatgatctcaagggcatacttgggtcattgccagagggatttgatcactattttgctagccgatttccaaagttgctaattgaggtgtacaaggtcttgtgggtgcactgcaaggacgaagaagctttcagtaaacatttcaatggaagctccttatagctggagaggatngcctntttctactgtaaatactaaccctgatgtagaagttgtatgtacatttggtatgtataccatattacccgttttata

SEQ ID NO: 81272 - DNA, 65 bp, Zea mays
  Clone ID: LIB3088-002-Q1-K1-H9
gtatttgttagcaaacaatttttgagatattaaagtcggtgataatataagtgttgttcgttttt

SEQ ID NO: 81273 - DNA, 345 bp, Zea mays
  unsure at all n locations
  Clone ID: LIB3088-003-Q1-K1-A1
acttgatatcaggcaagaatctgaccggcttactgatgttatggatgctataactgaatagctcggtgttggatcataccgtaaatggccagaggagaaacgccaagaatggctactatcggaacttaatggaaagaggccgttatttggtccggaccttcccaagtcagatgagattgctgatgttctagatactttccacgtattagctgaacttncatcagacagctttggtgcatatgtaatatctatggcgactgctccctcagatgttcttgctgtcgagctcttgcagcgtgaatgccatgtgaaaaaaccactgagagtcgttccattgttcgaaaa

SEQ ID NO: 81274 - DNA, 118 bp, Zea mays
  Clone ID: LIB3088-003-Q1-K1-A10
gattaaggcactgggaaacctcctgacaccgtactcgcaagtcaagcaacaaatttgagggattttgtgttgtactagggattgcttatgttattatctgaattggtggtttcttttc

SEQ ID NO: 81275 - DNA, 246 bp, Zea mays
  Clone ID: LIB3088-003-Q1-K1-A2
gtgctgtttgaggtcccctgtgcacggcctgccttgaaccctacttttccaaaagaggaagttagcgtgccgttatggcctttccactcccaaaagaaggccgttcttgatcagattgttgacccctacctgaagggaaagatagctccacaatgcttctagaagtttgctgagacagccgagatgtgtgtttctgatcagagtattgaccgcccctcgatgggcgatgtgctctggaacttggag

SEQ ID NO: 81276 - DNA, 257 bp, Zea mays
  unsure at all n locations
  Clone ID: LIB3088-003-Q1-K1-A3
acgcgtaccggtcacgcctacccgtgcacccaatgttcagaccacgcgtccgggtgctgaagcaggtgcagcccgacatcggcatatcctccaaggccatgtccatcatgaactccttcatcaacgacatctttgagaagctggccggcgaggccgccaagctggcgcggtacaacaagaagcccaccatcacgtnccgcgagatccagacctccgtgcgcctagtcctccccggagagctcgccaagcacgccgtc

SEQ ID NO: 81277 - DNA, 122 bp, Zea mays
  unsure at all n locations
  Clone ID: LIB3088-003-Q1-K1-A4
tcctcccgccaacccttccaaaaaaaaaaaaaaaaacttttttttttctancatnncaanaaaaaaaaaagaaaggactttattttattacttttcttccccaacaaaaaaaatcataaaat

SEQ ID NO: 81278 - DNA, 368 bp, Zea mays
  unsure at all n locations
  Clone ID: LIB3088-003-Q1-K1-A5
cggacgcgtgggtgtgaatccttccccaaagtttgcttggccattgactccatccgcctggttggtaaaggaagccctgccaaagaaccgctggtgatggcatggctgggatctgtcttcacaatgctggtggctctgatactcccatgcgcgtgctacctctccatcaagaagggtgcagtgccattgtgggagatcatcctgtgcatagtcatcataatgatcggcgccgtatgtgcatgcgtgggatcatacacctcagtcagccagatgattagcagcaccagatagcgcacgctagctgatatttatctagtgtctatggatccttccaaatgncttgataagagtggaactggcagcttttc

SEQ ID NO: 81279 - DNA, 335 bp, Zea mays
  unsure at all n locations
  Clone ID: LIB3088-003-Q1-K1-A6
caggaggagaacggtgcagcagatactacccctaagaaaaagaaaaggaaaacccgtgaggcttcggaagaacctgaccctaaaaccgccccggttggtaaaaagaaaaaaaagaaggttaaggccgaggttgatgagtagccaagtttttgggtgtatggcgtatgaatccgagaggtttttgttgaaaaacagagatgaatcgcctgctagctcaactagcttgtagttcatggaggcgttgatgcanacccaactcanagtacgaagttttcctatcgnctnntagctggatttttattttttgggtggatatgctagtgaactctagtgac

SEQ ID NO: 81280 - DNA, 191 bp, Zea mays
  unsure at all n locations
  Clone ID: LIB3088-003-Q1-K1-A8
gcgtcaggcntnnnntnntncccaatgtgcagtgttatactcaagcattgcacagggccaggcctcatctgccaattcagcccctcgttcaaaatcacagcatcagcgacagcatgcggcacataatctgccggatagctattcatctgccaaccaacctgccacttttacacaacagcagcaggagaaac

SEQ ID NO: 81281 - DNA, 424 bp, Zea mays
  unsure at all n locations
  Clone ID: LIB3088-003-Q1-K1-A9
gggnggngtgcgcccacgcgtccgcccacgcgtccggcagtactatgaaatttctgccaagagcaactacaactttgagaaacctttcctgtacctcgcaaggaagctggctggtgatccgaaccttcactttgttgaagctgttgctcttaagcctccggaagttaccatcgacatggctatgcagcagcagcatgaagctgagcttgctgcagcagctgcacaacctcttcctgatgacgatgatgatctgattgagtagaaaggatcatgagtcttgaacttgagcaggagttgtgccttgcgtgttttaagttgttctagggtgaactcttgagttctcattgtctggatcatctttttctccttggatgtgtngcatcttttgagtgtggaaatggatggtactcctcgccatgaattt

SEQ ID NO: 81282 - DNA, 419 bp, Zea mays
  Clone ID: LIB3088-003-Q1-K1-B10
cccactcgtccgcccacgcgtccgcggactcttgggtgctgaactgaagctggttggggagtatgggctgaggtgcaagcgtgagctttggagggtccagtatgcactgagcaggatccgtaatgctgcaaggcacttgctcacccttgacgagaagaacccccgtcgtatctttgagggtgaggcacttcttcgccgcatgaaccgctatgggctgcttgctgaaggtcagaacaagcttgattatgttcttgccctcaccgctgagaacttcctcgcaaggcggcttcaaacacttgtcttcaaggctggcatggccaagtccattcaccatgctcgtgtcttgatcaagcagcgtcacatcagggttggcaggcaaaatgtcaacgtcccatcattcatggtgagggtggagtctg

SEQ ID NO: 81283 - DNA, 462 bp, Zea mays
  unsure at all n locations
  Clone ID: LIB3088-002-Q1-K1-H2
ctcactcaactgaagcagcagaacaaaccagataagttaggtcccacaccggaaaatgagccgaactcggacacgatgttgaaagcctggggtggcagccaccacaagagcatttcctccacacagcgccatgacgctgaatccctccaatcagtcctccaaaatttcagcctagcccagaatgacaggttggagtcagaaaagaacagatattctgattccgtgctagtctcatcggctttctattctgcagacggtccacaaactacctgccttacacctaacatgacacangtgcagcaggactgcatatcaagctcctgggagatgcctcaaggtggacctctaggcgagatcttaacgaactccaagattagtgaggacttaagcaagtgtggatctaggtcatatggttggttattgaatcttgaccatgcaccatgattcctcaatccatggaga

SEQ ID NO: 81284 - DNA, 89 bp, Zea mays
  Clone ID: LIB3088-003-Q1-K1-B11
gggtcaccttactgaccggacgcatgagttcattgacggtactgactggttcatgaggccgctctcatgtgcgtgggctggaaacagaa

SEQ ID NO: 81285 - DNA, 138 bp, Zea mays
  Clone ID: LIB3088-003-Q1-K1-B4
cccacgccttccatttgcccatggagcagctttcttcctgaaggaaaggctgttggcccgggtggccccttccagggtccttgtttttaaaaatggtggcctcttcccattggctattctaaggaaaacctcgttgga

SEQ ID NO: 81286 - DNA, 105 bp, Zea mays
  Clone ID: LIB3088-003-Q1-K1-B5
cggacgccttggcccgcatcctctcataagcttccttccacattcgtctggagatctcgcgggggggccttggccccatccaccagcttggtgattcccttccgg

SEQ ID NO: 81287 - DNA, 422 bp, Zea mays
  Clone ID: LIB3088-025-Q1-K1-B7
ctgccgagccacatctcaggcctctgcagcttggtttctcgtcgagtcggctcaccgcgcgtggctgactcagttgcgcacgtctaagatcgatgactgcgccgttgtctgcctgttcctgaacacagacaaagcgagcgaatcgtcgagttctttggccaagaacttggcagatgctgtagaagttagcagtgccgggcgcgccacaactgtccaggtgagcgctggtgcatctacagatgttgccgccctggtaccagtaccagatgggaacgaggtgtctattgctgaaaccatcacaaagctggtcacgctcatggatttgcccaatgatggttgaggctcctgtgattgggacctgaactaagatataccacatctgggggtgctgcttgcagtttttttttctgaacgcaagtgtg

SEQ ID NO: 81288 - DNA, 112 bp, Zea mays
  Clone ID: LIB3088-025-Q1-K1-B8
cggacgcgtgggcggacgcgtgggcggactcgtgggctggaagttgttttccgcaagaaagttccagagatccggaagcttggttttggccagactggcgtcaagtgtactc

SEQ ID NO: 81289 - DNA, 286 bp, Zea mays
  Clone ID: LIB3088-025-Q1-K1-C1
ttctcctacccctcctgttctttttctttttcattaagttctccaatattcggtttcgtgaattatcaaatcgagatggcgcccatcaaattttcaatacctttacttctttctcttccttttcttttccacttactaccacttccttcacaacaccttcaacatttactactaattcctctattccaatatcatcctttatctatatactcatattttcctcttcttctacttcttcaccttctccactttatatactattccttaactccattcatttcattaa

SEQ ID NO: 81290 - DNA, 398 bp, Zea mays
  Clone ID: LIB3088-025-Q1-K1-C10
gcgcccacacgtccgggccgttgatgctctccctgagaagctacgagctgctgctatgataccggtcatgacaccattgcgctgcagacctgtacatggcgacactcacaccaccaattgaaggatatattgaaaaagtgcgggaagcggccaagaagcactctgtgaaggagaaacttcgctgagaattcaagagaggaaactgtttccgtaaggtgaataaatattcaacctaatgtacaagaacagctttggcacaaactgcaattgccatatttggtgatctagtcaggcatcccaatttgcttagcagccattatctattgaaatccttttggccattttatccactctacaggaattttttttgcaatatccctagactggcatttcatttt

SEQ ID NO: 81291 - DNA, 319 bp, Zea mays
  Clone ID: LIB3088-025-Q1-K1-C11
gaactaccggatcgacccacgctaacgaaattctacacaagcataccaaacttatcattttcatcaatctaaaatataaaaataggaaacggttccatcttaaacaagagatggatacaaatacacactctacatcatcttcctactttgccttccttcactaaagttccatctctcgcttcttccaagcaccaccaccctcttcactctctttcatctcaaccatctctaaactctccattacactacattcttttttataatcatcacccatccaacaatatccattcctatacatataaatacattattattaatt

SEQ ID NO: 81292 - DNA, 334 bp, Zea mays
  Clone ID: LIB3088-025-Q1-K1-C12
gcgcccacgcgtacgagccatgccatgtccacttctctgcctgcaacccgttcgccgggtcccgtgcccgttgtctttggcatctggccaaccactagactttgcttctaaaccagaggctccatctgtgtgccgccttgttttactagaaatccttcttgattctatcctttttcacttgtcctgcctagtttttttacttatcctgccattgtacaaacaatttctccagtgcttgtagcttgtggacttgggatggccaacatgtcatgaatacaaactgagtttgcttcagatatatttttttggggtgccttccataaattaaattttt

SEQ ID NO: 81293 - DNA, 232 bp, Zea mays
  Clone ID: LIB3088-025-Q1-K1-C2
aattcgacggtcgactgacgcgttcgctgacgcttctgctgacgcttggtctgactcttgggctcgaaattgttttccgcgggaaatgtccatatatcccggagcttgtttttcgccatactgtcttcaattccgcttcttccttaacggacttcacttggacacttactacctctggcttcacaacatcttaattatctacattcattactctaattccaagatcatacta

SEQ ID NO: 81294 - DNA, 406 bp, Zea mays
  Clone ID: LIB3088-025-Q1-K1-C4
cgcaaggatggtgaatatgttctgacttacgaggacaaggatggagattggatgcttgttggcgatgtaccatgggagatgttcgctgactcttgccgcaggctcaggatcatgaaaggatcagatgcaattggacttgctccaagggcagctgataagtccaagaatcgcaactagaatggttgcttcttacagtccagagcaagagggagatatccagtgactgtagggatctttgtggaagccggaaaacgtctaacagtttcaagaagaattctgccttatggtctgtaccacatgtttttgctgctacgcaagtaaagaactccacgtctgtcaatgttagttttacaacatcgtctacggacaaaaaaaaaaccccccgctatttgattggtgctaaacc

SEQ ID NO: 81295 - DNA, 408 bp, Zea mays
  unsure at all n locations
  Clone ID: LIB3088-025-Q1-K1-C5
ggcttctcctccccctccggttcgggttcgggttcgtgaggttctccggggttcggtttggggggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcataggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaagcggcggcngcggcgggtacggtggtggccgtggaagctgcggctacggcggtggc

SEQ ID NO: 81296 - DNA, 380 bp, Zea mays
  Clone ID: LIB3088-025-Q1-K1-C6
gcgccgttgtataagaccttggaatgccaaaaaatgtttataacatggatttcagggaatggtctttgatgcaagtctgatagaatgacccatcggttatctgagtgggcgtcagccgtcaggaatcctctttgaagggtcagttgcttgggtttctttggtgtcaactggttcaaatccttgatcgatatggttgatcgtaatatttttggaacttatttcaagatttattaacggtattgttctcttaagacctgcctgttgattctgttcatataggtgaacgtgcatatgttgttgctatatgcatacatggggacatggggttgtagggtgcttgtgcgttcgtacaaaaaataaagtgccaatttggattaaaa

SEQ ID NO: 81297 - DNA, 363 bp, Zea mays
  Clone ID: LIB3088-025-Q1-K1-C7
gagaagcccgccaagggcaggaaggggaaggccggcaaggaccccaacaagcctaagagggctcccagcgctttcttcgtgttcatggaggaatttcgcaaggagttcaaggagaagaaccctaagaacaagtctgtcgctgcggtgggaaaagctgctggcgacaggtggaaatccctgagcgagtcggacaaggctccctatgtagccaaggctaacaagctcaagctagagtacaacaaggccatcgcagcctacaacaagggcgagagcactgcagctaagaaggctcctgccaaggaagaagaggaggaagacgaagaggagtctgacaagtccaagtcggaggtcaatgacgaggat

SEQ ID NO: 81298 - DNA, 390 bp, Zea mays
  Clone ID: LIB3088-025-Q1-K1-C9
ggtttctaccgacttccttggtgacagcaggtcgagcatcttcgacgccaagggggggatggctctgaacgaccacttggtcgagctcgtctcgtggtacgacaacgagtggggctacagcaaccgcgtcgtcgacctgatccgccacatgttcaagacccagtaggggtttttcccccctgcttctcatggatggttgctgcttgtgtatgccgagaataaatgtggatggcgcgtgcctctgggtcgccaggttcatgctgagtctggacatgttttgcacttttgtttcccttcctgctaccatctgtgacagatccgctcgctaatatgggacctgagattagctttatgctgcttgtggtgaaaaaaaaaaatatttaaaagggc

SEQ ID NO: 81299 - DNA, 313 bp, Zea mays
  Clone ID: LIB3088-025-Q1-K1-D10
acgacgaggagcttgggaagctgttgggcggcgtgaccatcgctcacggcggtgggctccgcaatatctaccctggtctgctgcgccaagaagacagcagagaaggcgtccagtggcgggagcaaggttgcaaagtcgcccaagaaggccgacaagtgccctaagaaggcatacactgactgtccagagtgatctgatgtttagcagtaccttgttaccagtattcgttgattcgtaggctgcaaattgtacaaatgttcttgtatatgtatgtgtcctgcttcaaggtgctctgtgctatttataatggaag

SEQ ID NO: 81300 - DNA, 293 bp, Zea mays
  Clone ID: LIB3088-025-Q1-K1-D11
cgacccacgcttacgaaacacttacacgaaaaccacgttttcttattgagcctcagttcacacacaacgatttggtattttacaagatgcgtgacggctcctatatttcacctgatgaacaacatcttattaagcaccccactctatcttactatattacaatatgcgaccagcatataatggaatctgtaatagatcaaaccctaactcctttttctgctttacagaccaatacacactatcatcagtgatttcctgcaaactctattcatcaaaatatatcttctctagaa

SEQ ID NO: 81301 - DNA, 355 bp, Zea mays
  Clone ID: LIB3088-025-Q1-K1-D12
cccacgcgtccgcccacgcgtccgtccacgcgtccgggaagaacgcattttgatggctgcggaggaacctgctggacagggcggtgaagatggtcgccgaactggacgagccagcagagatgaactacgtgcgcaagcacgcccaggagcaggcggaggagctcggcgtgtcgctaagggaggcggcgacaagggtgttctcgaacgcatcaggctcctactcgtccaacgtgaacctggccgtggagaacgcgtcatggaccgacgagaagcagcttcaggacatgtacctgagccgcaagtccttcgcgttcgacagcgacaccctcagggcaggcatgaatgagaagcgcaa

SEQ ID NO: 81302 - DNA, 372 bp, Zea mays
  Clone ID: LIB3088-025-Q1-K1-D2
gcgatcggggctttttgtgagttcagaccgaaagagtggtccttcgtgatctaattcaactactgcatgggctattttccatggacgtgatagtaaaggtatattttatttctcgaacgcgcatgagagctgcacatcattatattaagagaggaaaggtccaaagtggaccgaaatacaacaccaagaccaaacccttaagccttcactccagcacccctacaaatggggtggggggagagcctgactgaccctactagaccctatttagggcttgttcggatattactaatacacatcgattggatgtgattggaaaaaattgagaagaattttgactcgattgtgattcaaacccattcaatttcactt

SEQ ID NO: 81303 - DNA, 340 bp, Zea mays
  Clone ID: LIB3088-025-Q1-K1-D3
gcgggtgcaagtcatgaacctctctctctcatctcggcatttgaaatcagtgtgtttaattgcgtacttggtctctctctctctggctaccgtggtttttggaagaactctctagatgtacaagttaatactactagtactttccacacctattgcagctgaattagagaactgtttttgagttctcatgcattattagagttgtcaagggttcatgaatcaagttatccagctagctactttctttctccctgcttctacttctatagtggaattaatttctccttctttctcgggggttttttttgttcaaacttggcttgtaccaattatgattgct

SEQ ID NO: 81304 - DNA, 336 bp, Zea mays
  Clone ID: LIB3088-025-Q1-K1-B5
catcatgagaggcttactgcacttgaagctatgacgcacccgtacttccaacaagggagagccgatgagaacagcagggcgcgagcgtgacaggcaaagagcgaagaccatctgctcttttatcattcagtcaggttgtatgagatgagtagccgttgggtcacttggcagaaaataaacaatagccgtagagcctgtactgtacgtaacgtaacctcctcgatgagttgtgaggtttgggacgtgattgcgaacatggtatattaatgattgctcatgtaaggtgctgcatggtttaagatatgtaacacaaatggtaatggtaaaacaaatgct

SEQ ID NO: 81305 - DNA, 193 bp, Zea mays
  Clone ID: LIB3088-025-Q1-K1-D4
gcgcccacgcgtccggtgattgtaaggaataagtaaactccctggtaaaatatatgattaaggggtggaggttaagacactagagagaatataggggggctctaactaccatggcttaatcatatattttaccagggagtttagtgattgtaaggaataagtattatacatgtctttatcaagtttttttttc

SEQ ID NO: 81306 - DNA, 384 bp, Zea mays
  unsure at all n locations
  Clone ID: LIB3088-024-Q1-K1-H2
cacgcgtccgtccacagctgatgttctgcaaatattccagcagatgtgtgaagggctgaaacacatgcgcagctttgatcctccatacgctcataatgatgttaagcctggtaatgttcttataacctggcgtaaaggacaagcacctgttgcaactttaatggattttggaagtgcaaggcctgcaagaaaggaaatccgttctcgttctgaggcactacagttgcaggaatgggccgctgagcattgctctgctccttaccgggcccctgaattatgggactgcccaagccatgccgatattgatgagaggacagacatctggtctctaggatgcactctntttgctatcatgtacaatgtttcaccatttgagtatgctct

SEQ ID NO: 81307 - DNA, 396 bp, Zea mays
  unsure at all n locations
  Clone ID: LIB3088-024-Q1-K1-H4
ttggcttttcaatcattngnnttggcannatttaccctgcgggatgaggttgcgtgagtttttcttcaattcgagagggaagtgaggcatgccctttaattgnngccgggccattngnnatgatcatganncatgcatacgagtcctnntgaatttctgaagnntctgatccgagttgtagaatgcctcnntttatgatttgcaaaagtgaagggttgattgtggccaaggtttttttaggattcaagggctgannaattgatttcaatggagttagttctggtacataaattattttggaaaaggaccctggacgtgggagttggggccaaaacccagttccgggaaagcttgcaatgtcccaagggatgatacccggaattgctaaagggtcat

SEQ ID NO: 81308 - DNA, 403 bp, Zea mays
  Clone ID: LIB3088-024-Q1-K1-H5
gatttaagaagttccatggggttgctgagaacccaagtgagaaaatcgtgaccaatcgggaatctttcttggaaaagcgagggttgccaaaaaatcttgtcctcggaagctgcacagttctcgaaacagcatgggaaggggcacttgccacattatataaggttttagagtctgctgttgcagacagaggaactgggtcctcggcacagggacaagtaatttggatccactttggggtcaacagtggcgcaataaggtttgcccttgagaaccaagctgttaatgaggctaccttccggtgtccagatgagctaggatggaaaccacagagggtccctattgtgccctctgatggaagcatctcacggacgagagagactaccctgccagtcaatgaattaac

SEQ ID NO: 81309 - DNA, 342 bp, Zea mays
  Clone ID: LIB3088-024-Q1-K1-H6
cccacgcgtccgcccacgcgtccgcccacgcgtccgggtaacgaagccctctatgacgtgtgcttcaggactcttgaggtgaccacccctagctttggtgatctgaaccatttgatctctgcaaccatgagtggagtcacctgctgcctaaggttccctggtcagctgaactccgacctcaggaagctggcagtgaacctgatccccttcccccgtctccacttcttcatggtcggcttcgcgccgctgacgtcccgtggctcccagcagtaccgggccctcacagtccccgagctcacgcagcagatgtgggatgccaagaacatgatgtgtgccgctgac

SEQ ID NO: 81310 - DNA, 230 bp, Zea mays
  Clone ID: LIB3088-025-Q1-K1-A1
aaaaaaacattatttcttcatctattacttttttatttataaaaataacctaaaattacacgtaattgcttaaaatccactttggtcaagacataaacaaaaaacttttaatacggggtccctcttactttcttttttatatcatttttttccctttctttagatcccaatcttttttcttcctatttcctaactattaattccttttttacttcacatttacttaattt

SEQ ID NO: 81311 - DNA, 400 bp, Zea mays
  Clone ID: LIB3088-025-Q1-K1-A10
agttagtccaggctaatcctcaaatcttgcagccaatgcttcaagagctaggtaaacaaaagccacaaattctgcggttgattcaggaaaatcaagctgagtttctccgcttggtgaatgaatctcctgagggtggtcctggagggaacatactaggtcaactggcagctgctgtgccacaaacgctgacagttaccccagaggaacgggaggctatccagcggctcgagggaatggggttcaaccgtgagcttgtgctagaagttttctttgcatgcaacaaggacgaagagcttacagccaactaccttctggatcatggccatgagtttgacgagcagcagcaatagacgtggggtggatggaagaaaccgatgcagttgcagaacagcgagtgtcg

SEQ ID NO: 81312 - DNA, 387 bp, Zea mays
  Clone ID: LIB3088-025-Q1-K1-A11
agcagggtgtcccggccctctctagtttctactcccggcccccaacattggcctggggctgcggccatgtagcccagggctccggcctcggcttcaccggcggcggcggcaacgacggtgaaaactacatcgggtgctagctccgacggtggtgcgtgccctgttgacgatagggcacgcggagcgcgggcagcttgtaagcgttcgatcggccatgtatggcaactatacatctttggcaggtctccatcatcctgcgtgggagagaagatggtaatggactgcgtgtgtatgtatgtgtatgcccaagggcgcgcgcacacggttctgggcgagtaacagtagaaatgcaatatcatgtatccagtatctttcttacaacacaaa

SEQ ID NO: 81313 - DNA, 401 bp, Zea mays
  Clone ID: LIB3088-025-Q1-K1-A3
cggacgcgtggggtgctgcagctagtgcggttgatgcagatcttgaccctcttattgcagggcttcgtccaatgcgacttcgagagaaactgggcagggagcttcgtggccggcttggtttgagattgttcaatatagatatgattagagaacttggaaccaaagatcggtactacataattgatatcaactacttcccaggttacggcaaaatgccaggatatgagcgcatgttcacagacttcttactaagtctcgcacaaagcaagtacaaaaggtacttaagcgggacatgaggtgcaaggaagtttgtgaagaccatgctactgactagatggcatataacggtggcaggtatgctttcccaccgcgccaatgtacatttgctggagacataagca

SEQ ID NO: 81314 - DNA, 392 bp, Zea mays
  Clone ID: LIB3088-025-Q1-K1-A6
ctctctaaaatttctgctgtacatgaaaaaggcactgttgctaaagcttctgagaaggatggtaaagcacacaaagagaagaggggtgatcaaaatttggagataaaggcacttcgcaataaagctgctgagtggcaattgaaagtactcgagaacgagggcattctgaacgcaaaggagaaagaaagggatcaaagagttgcagagaacaatctgaagatgaacgcgttgaaatctgaagtcgaatcggagcacaagtgccatgcggagaaagaaataaaaataaaggaaaagcttgaaaaggttgctgaattatgctctcaagctgattccgttgctgaagctggaaataagaaaatacaagaaatctgtgggaagtataatcaaatttg

SEQ ID NO: 81315 - DNA, 242 bp, Zea mays
  Clone ID: LIB3088-025-Q1-K1-A7
atatactggaactcctgctgtctgctcattttttctggagagactttatgtaacgaacaggactgtgtcaatggggggagtggtacaaaccactctgtgtatgggcctctctatcagaaacagcaatgagactacacgtatgtcacctacagtcattaaactcatgagcacatcatcgacttactagaactaaaatatgtggataaactgtccacactatgcatcattgatcacttattcac

SEQ ID NO: 81316 - DNA, 266 bp, Zea mays
  Clone ID: LIB3088-025-Q1-K1-A9
gacgcgtacgcccacgcgtacgcggacgcatggaaacttttagactaactcaggtcctagcgtgtctgttctcttgaagtggcaggggagacttatcatctgcctaatgttttgatacccctttccgtactacttggctcgtaattaggtatgccatatacgcttgctattccatgtacatgtataaatcttacacattctactggcccaattaacatgagtatgcatattatctatatttgtgttcattatacgtattgctgata

SEQ ID NO: 81317 - DNA, 410 bp, Zea mays
  unsure at all n locations
  Clone ID: LIB3088-025-Q1-K1-B1
gcgtgccggaatccatgagacaacatacaattcaatcatgaagtgcgacgtggatatcatgaaggacctgtacngcaacattgtgcgtcagtggacgttcgactatgttcccgggaatcgctgatcgtatgagcaaggagatcactgtccttgcaccaagcaccatgaagatcaaggtcgatgcaccgcctgagaggaagtatagtgtctggataggacggtccatcctagcctcgctgagcactttccaacagatgtggatatataaggaggagtacgatgagtatgtcccggcaattgttcacaggaagagcttataggcttcgcaaggtcctcatcagtgcctagtctcaagttatgtcccctacatttctcaagatacgcgtggcagatatgcatggtacggttca

SEQ ID NO: 81318 - DNA, 301 bp, Zea mays
  Clone ID: LIB3088-025-Q1-K1-B10
ctctctccgcacagcagctttgcgaaaacctttttaagcaaaccaccggagcatcggggctgggtctggctgagccagggcagaggactattacaacgaaattgacatggggtatgaggatgagcccccataaccggagattgaggaaggatctgaacaagagcttgagaacaactaatatgcccctgatgacatcataagtggttagggttaacataaggagcaggataagaccaagcgtgaacgcaaatcaacttgatacatgacgaagtactaacgtgctttcatcctgagtacacga

SEQ ID NO: 81319 - DNA, 456 bp, Zea mays
  Clone ID: LIB3088-025-Q1-K1-B11
ggaagaggctgcgatgcgtcaaggcgcgtgacgatggctcgccatcgccgtctgagaggtctgggactcgccataccccgtgctgctaggcccctccttggagctgacattgcggcattccggcgccctagcacctttaaccgcaggaaatcagattcactagtgaacgagtacaggcactcgatggcgctatcgctggagaaggacaagtattacacaacgaggggttcaccgttcgatggaaacgggttcgactttggtagcatagctgacgagaagggaaccaccgcgttgcctagattcttcgtagcattgtcgaacaaggagaaggaggaggacttcatggcaatgaagggctgcaagctgccacagaggccaaagaagcggcccaagctgatgcataagtgcttgcttatggtgagcccatgagcttggttatcagatttgtcgcatgag

SEQ ID NO: 81320 - DNA, 73 bp, Zea mays
  Clone ID: LIB3088-024-Q1-K1-H12
gagaacataaagaacatgattttggatatacctgtcaaagattgatacatgtttcccatcgaggcaatttcca

SEQ ID NO: 81321 - DNA, 418 bp, Zea mays
  Clone ID: LIB3088-025-Q1-K1-B2
gcgtattagttatagccacaactatagctgccctgcctgaactgaactagcacttgatctccttaagaccggtagatataatagaggggtgtgggattagtggcaccatccttgtaataggcgaataccacggacgcttcgtccttcatgctctcaccatgcaagttgcaagctcatgattggcagttaagaaagataccctactgagatagtgccaatgggtgctcttgcatgtaatgtactactactacaactgtgtacaggacacttgtgtaaatgcacataggttagcagcttgcttcttgactaacacctaatgggcatttatgttgtgctaaccgaatgacaaaattagctcgtttagttgtgataatcgttatctagtgagtggggaatgataccgatatcttcgttcttt

SEQ ID NO: 81322 - DNA, 77 bp, Zea mays
  Clone ID: LIB3088-025-Q1-K1-B3
aaaaaaaaaaactaaaaaaataactaaacattaaaattttaaacaaaaaaaaaatacaacaagaaaccgtttaatat

SEQ ID NO: 81323 - DNA, 421 bp, Zea mays
  unsure at all n locations
  Clone ID: LIB3088-024-Q1-K1-E3
acgcgtccgcggacgcgtggnggcggcggctgatgtggagtaccgttgcttcgtcggcgggcttgccggggccaccagcaacgagtcggtggagaatgccttcgcctgctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggctatggtggcgggcgccgtgacggcggttatggcggcngtggcggctaccgctgtcggcgcgagggttgtggcggcggctacggaagcggt

SEQ ID NO: 81324 - DNA, 349 bp, Zea mays
  Clone ID: LIB3088-024-Q1-K1-E4
acgcgtccgcccacgcgtgcgcgcataacaagatggatttcctgcctaagaaagagttcgatacgtacggctgcgcgtatgagccctagtagcagtgtccaagatcagattcaagagctacttacagttcaagagacgatgacttgtggagcaagaattcacgctttggctcgaatctactctgctggagagccccaaaacagtccatgtaatggaggaaagaacgagtgaactgggtggaacaaatcgattctgctacgagattttaccaattttgcccgaagctggagacatggacaccacctacggctgctgggacatattttgaagggaaatctgggaggggtct

SEQ ID NO: 81325 - DNA, 369 bp, Zea mays
  Clone ID: LIB3088-024-Q1-K1-E5
gaagggggacaaggagctcgttggcaccctctgcggcgttgatgtctacgtcaatatggggctggaggacgtcaccgagtatgaatacactgctgaagggcgccgcattacaaaacttgaccagatcctcctaaacggcaacaacatagccattttggttcctggtggttcaccacccgatgtgtaatgagcttttgctccccagagtaaccattcgaggcgaaggcatctccatggactttgcacgttattttgggtaatcattggatgtttcgtcatctcggatgtgttcatcctgttcgtgattataccaagtttattgttaactctctttcagcatggaagctgccttctgtatcgaacttactg

SEQ ID NO: 81326 - DNA, 289 bp, Zea mays
  Clone ID: LIB3088-024-Q1-K1-E9
cccacgcgtacgcatacactacatccacaaaatattcctgctcaaaagcattcttgctactatccaattcggactatgtgtggagtttactgggtcacaatttagatcttcgacgaaatagaattcctcaccatctatagcaactatcgaccacctatagaacaaataccacaagaaccttactttcccaaaaatccataaggcaagtacaaagaccaggcggatctagaagctccaagactacaataggctgcttgcgatccaataccttttctatatgagtcaacta

SEQ ID NO: 81327 - DNA, 320 bp, Zea mays
  Clone ID: LIB3088-024-Q1-K1-F1
cgcgtacgatcaacactttgttgttgatcacttatgttccaaattctgagtttgacgctggagcatgcctcatttgatgctggaaaggaaaaaaaaaaaaaaaaaaagaaaaaaaaaaaaaaaaaaaaaaaaaaaaaaaaaaaaaaaaaaaaaaaaaaaaaaaaaaaaaaaaaaaaaaaaaaggggcggccgtttaaaagaatcaaagtttactaacccttgaatgcaacttaaaaccttttaaaaagggtaaccaaaattaaattaatgggccgttgtttaaaaacttttaaactggaaaaaccctggcttaaccaaat

SEQ ID NO: 81328 - DNA, 363 bp, Zea mays
  unsure at all n locations
  Clone ID: LIB3088-024-Q1-K1-F2
gcacgcgtccgcggacgcgtgggtgcgacgagtccgacgtctgctccgcggccgactccgcccggtggagcagcttccaagccaccacggcgcccgcgtcgcccacgtacaacctcgtccacccggcctncgactccatggagctggacgggacgacggcagccgtcgaggagttcgagttcgacaagggccgcgtcgtcacgccatgggaaggcgagcggatccacgaggtggccgccgaggagctcgagctcacgctcggcgtcngcgccaagtgaagcgaagctctcaagcaaagctcggatctttgagctcccgtactgcaaatgccgcgattggcagaaaaaaaaatgtgtacgtact

SEQ ID NO: 81329 - DNA, 355 bp, Zea mays
  Clone ID: LIB3088-024-Q1-K1-F3
ggggttcagaggattgccatctacgagtacatggaaagcggcaatctgcacaacctactgcacgacttgccactaggagtgcaggcaaccgaagactggagtggcgacacatgggaggacaacaccggtggtgttgcaacaactgaaatcgtcacgccggaaggtactgcaacatggatattccggcacaaaatcgccctaggtgccgcaagggcgctggcattcctccaccatggctgtatcccgcagattgtccaccgggacgtgaaggcaagcagcatctacttcgactgcgcaatggagcctaagcttgccgatttcgggctgtcgatggtggcaggaaccagggccgatc

SEQ ID NO: 81330 - DNA, 468 bp, Zea mays
  Clone ID: LIB3088-024-Q1-K1-F4
cgcgtccgcccacgcgtgcgggtacaccgaccgagctcagcttacctccactccagctacaatcacagtcgttaccagagcgagagcgagctatatggccgtgaaaatgcccatcaataagatcgccctggggagccaccagtaggtgtaccacccggtcgccctcaatgcggcgttcgctgagttcatctgcaccctcatcttcgtcttcgccggccagggctccggcatggccttcagtgagtcctacgctgtccgctcctacccatgtgcatgcaacacaggctcgatcggccctcgtcctgccttcaacgagcagctagctagttagcctgccctgtacacggcacgccccatcaacagctttacgacttcttctaagctggtctttaaacattttgtttaaaacatgctctagtatctctttgagcttcacttggtctgtcatgctctagcactagcacaagg

SEQ ID NO: 81331 - DNA, 354 bp, Zea mays
  Clone ID: LIB3088-024-Q1-K1-F5
caagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcacccctggatctacgagaagtaaacatggaaagtttcacatcaaaccttgagagccagaggaagcatgtcaccatttgtgctttagcaatgttttcgaaaagattatgatctgtatcttggaaccttatttcaatggaccaaatttctttctttgcc

SEQ ID NO: 81332 - DNA, 342 bp, Zea mays
  Clone ID: LIB3088-024-Q1-K1-F7
ggctctttacgtgtctaaggcagagaagctcaaggcggagtacaccaagaagatcgacgcttacaacaacaagcagtctggagaccccacggcgtctggtgattccgacaagtccaagtccgaggtgaacgacgaggacgaggagggtgacgagtgatgtatgacggatgaaactctgtccaagtgtttgcagtcagggaaaaaatctcgtcgttgtcggcctaaccgggttttctcgaaggactttctagatgcagtagattagtgccgtcttctgagtagtttccttgcaagtgtcgtcccgtccctggagtgaggcagtttagtttggagtttcttcgc

SEQ ID NO: 81333 - DNA, 162 bp, Zea mays
  Clone ID: LIB3088-024-Q1-K1-G1
ggagatggctagatattaccaagtggtgtatgctctttatgaagtgctacaagatgtagcaaataaaaacattgatgatcaggtgttgcggtgtgcagacatggttgaagaaaatggtcgtcatttcaagaactacaagtacaacattattcccctcaattt

SEQ ID NO: 81334 - DNA, 334 bp, Zea mays
  Clone ID: LIB3088-024-Q1-K1-G3
acgcgtccgcggacgcgtgggcgcgacgccgtcacctacacggagcacgcccggcgcaagaccgtcagagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaaatcgtgtgaatgggaatggatctctgttggattgttc

SEQ ID NO: 81335 - DNA, 371 bp, Zea mays
  Clone ID: LIB3088-024-Q1-K1-G4
acgcgtccggccccgacgccgaggtgctcgacgcgatcgacacggcagcgcgccagaagcagctgaaggtggtggcgaagctctactggggcgacgccagggagaagctctgcgacgccgtcgaggacctcaagatcgattccctcgtcatgggtagtcgcggcctcggcccgatccagaggattctcctgggaagcgtgacaaactacgtgctgtcaaacgcatcgtgcccggtgacagtcgtcaaggggaagtagcggcctggacagcgtgccagtgatatgaatgaagatgctagcgtgcagtttgtgtgggttatagctaaacactatgttccgtcttgttgctgcatttcaataaagcatgtgtct

SEQ ID NO: 81336 - DNA, 361 bp, Zea mays
  Clone ID: LIB3088-024-Q1-K1-G6
cccacgcgtccgatccatggagggagtgcacggcgctcgtcgcccagctcgaggtgcgagggcatgtctacctacccgaggacctacgatctcatccatgcggactcggtattcaccctgtacaggaacagggagaagatcctcctggttgtcaagacgtattggactacccatgaggccatgaccaagatcagtagcaggactgtcaagtaaaattctcaatgttgataagcatttttcatgtttggatttgtaccaccgtttctagctccttgagctagtgatctcttgacggtttgtgcttgctgttctttctggacagtacttgctcggataggaaatttaacatgtgggggaagga

SEQ ID NO: 81337 - DNA, 332 bp, Zea mays
  Clone ID: LIB3088-024-Q1-K1-G7
gtgcagtgcttccctgttccctccatcaagaaacagcggagatccagtgcagagagagggaagcgccatggcactctgaacaagaaaagaaagagctagagagatctcagtcagccagtctctcacaacacaatgccggcaaccaccaagccgatcttgctcccaagggcgtgggcagcagcgccactcctcctcctgctgctgctcgtcctgcacgggagaggaggccactgcgtcggcatggaggcggcggagctggagatggactcggaggcgcaccggcggctgctgtgggaggcgaccacggggcggaggtacatcagctacgacgc

SEQ ID NO: 81338 - DNA, 395 bp, Zea mays
  Clone ID: LIB3088-024-Q1-K1-G8
tagctttttgtatttgcctgttgattcttatatttatgtttattaagtgggggaatgggtagcttctaagaagggagggaacaacatccatttgatgtgaatcattcatggcacagtatgcaatattggcatatgtggtactatacatacacacttactgtactcacaacatatataatagaatggttgattaatttattaattataaattataaatgtcgtcctttctatatgatccaaacttacttactctttcattctatttttttacttttttattattgttcccttatttctattcacttcccttttttttattatttttttatctttaattatccttttctttttttattatttattttttttattttaatttttcttttacctttttt

SEQ ID NO: 81339 - DNA, 376 bp, Zea mays
  Clone ID: LIB3088-024-Q1-K1-H1
acgcgtccgggcgattcctaacgacgtccaactcggctagctgctgtctggcgtcaccatcgcgcacggcggtgtcctccgcaacatcgacccgtttctcctgcccaagaaggttgcggagaatgcgtccagcggcagcagctacgagagcaagtcccctaagaaggccgtcaagtccccaaagaaggcagccatgtccccgaagaaggcttagaaatcactcacttcactagcgctctgctgtagcatgttcgtgtctagatctgtggaacttatgtgtgccagcctaattacctatctgccttgtagctcctgatatgttcactggcatgttagccgagttgtgatccgtggactgattttgcaaatcatcatc

SEQ ID NO: 81340 - DNA, 294 bp, Zea mays
  Clone ID: LIB3088-024-Q1-K1-E11
cctttggaggcacgcattctaccactcgttcgctctctttcttccgtttcttatatccttcctcagattggcatttctggccatcttatcggcgaccagagctcccagttcaatgaagcattcatcctcttcgacaaggactgctactgcttcatcaccaccaatgaacttttaactgtgattctctcgtttgggcataaccctactgatgcttatcttcatgacatgatcaacgaggttgatgcttattgcaattgaaccatctacttccctgagtttcttaaccttattgca

SEQ ID NO: 81341 - DNA, 62 bp, Zea mays
  Clone ID: LIB3088-024-Q1-K1-H10
acccacgcgtgcgaccggaacgcatcacaccatcatgctgttatggcattgatggattctat

SEQ ID NO: 81342 - DNA, 436 bp, Zea mays
  unsure at all n locations
  Clone ID: LIB3088-047-Q1-K1-G6
cgaggagttcacttccgtcgtgctggacctcgtcagagggtgtattttgagtcanaagaggcgagagcttgcattgtaacctgtggaggcctttgccctgggctcaatactgtcatcagagagttggtttgtggcttgtcccacatgtacaacgttagcaatgtcttcggaatacagaatgggtacaaggggttctattcgagcaattatcttcccatgacaccaaagagtgtgaatgatatccacaaacgaggtggtacagttcttggaacatcacgaggtggccatgataccaaaaagatcgttgacaacattcaagatcgtggaattaatcaggtattcattataggaggagatggaactcanaagggtgcatatgagatttacaaggaaatccggagacgtggtctacaagtagctgttgctggtatttcca

SEQ ID NO: 81343 - DNA, 357 bp, Zea mays
  Clone ID: LIB3088-047-Q1-K1-G7
cggacgcgtgggcggacgcgtgggtggtgatattacagttgaattgccactctttatatggacgaagtaatcgtatgataatgataacaccattgtgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaataaataaaaaaaaaaatggggggggagatttttaaaggaggaaaatcaaaattgagtgacatgaaaagggattttttttttttggggggcgaaaaaataaaattgtggggcgtttaataaaaagggggttcatgaaaaa

SEQ ID NO: 81344 - DNA, 335 bp, Zea mays
  Clone ID: LIB3088-047-Q1-K1-G8
gaagatcgagttgcttaaattattggggtgcttgaaaagggcagctaaatcttgggagtggtttaccatccgcgagaagttgaatgcggcaaccagcagcatgttgaagtccccagaaggttgcgctattttgtttttgaaagggttgtatatgaaccatgatggttattaagaaaaagaatacaggtcagttacacgattttgtccaccacacaggtggtaagcttggaacttagctgtcattttttaatattaaaaacctaacgtggaaaaaaaaaaaaaaaaaaataaaaaaaaaaaaaaaaaaaaaaaaaaaaaaaaaaaaaaaagggcgg

SEQ ID NO: 81345 - DNA, 128 bp, Zea mays
  Clone ID: LIB3088-047-Q1-K1-G9
gtgactcgtgggcttgcccgtttttgcattatgtgaaaaggctttgatctggagggaggggacactctttcacacaccttaccactgcactacccatcctattatataaagcgccggaaactgatgct

SEQ ID NO: 81346 - DNA, 377 bp, Zea mays
  Clone ID: LIB3088-047-Q1-K1-H1
cccacgcgtccgaaaatatcagtttttggtgcttattcagaaagaaactaaaatgactttcaaatggcaaattgcacactttttataagctatgttgttctcacattagaccagttgattaatattgaacaattaatacagcaaaaaaaatgccatgaaccagctactatgtatgaacttgataagtatttttagcaggcactcaagactattacagtggactattcgtgtgtcacaagttttttgtagaaccagcacttatgatggtatttttcccattgaagctaaaactttttttattggtagactggttgctgggattgaaagaaaaattaactaagcgtgttatgagcacgtgattatttttgttaagttgc

SEQ ID NO: 81347 - DNA, 144 bp, Zea mays
  Clone ID: LIB3088-047-Q1-K1-H10
ttgggaatgcaaaatatggggatctcatatttctgtaaccctaaccttctgaaggcttagtctggtccaaaatatggatgactaggtcatgtttgacggctttagctttctttggtaatggttggccgaaactaatttgaccat

SEQ ID NO: 81348 - DNA, 413 bp, Zea mays
  Clone ID: LIB3088-047-Q1-K1-H11
gttctaagtggggaatttgttgtggtcaacaagcatcttcttcatgatctgactgaaatgggcatttggactcctaccttgaaaaaccagataatatacgatgacggttctgtccagaagatagcagaaatcccggacgatcttaaagcaatctacaaaactgtttgggagatcaagcagaaaactttagttgacatggcggttgaccgcggatgctacatcgaccaaagccagagcctcaatgtccacatggagcaagcaaactttgggaagctgacgtctcttcacttccatgcttggtccaagggcctgaaaactggaatgtactatctacgcacacgagctgctgctgatgcgatcaagttcacagtggataccacgcttctgaaggagaatgggaacggggttagcga

SEQ ID NO: 81349 - DNA, 229 bp, Zea mays
  Clone ID: LIB3088-047-Q1-K1-H12
aataaaataataaaaaaaaaaaaaaaaaaaaaataaaataaaaaaaaaaaaaaaaaaaataaaaggggtggccgttttatattataaaaatttacatacctgttcatgaaacgaaatagattttttttagttgaacttaaattaaatcaactgtgctgcatttaaaaaagtcataacttgaaaaaccatatggttcacaaaataaatgggtttgtaacaaatctccttt

SEQ ID NO: 81350 - DNA, 412 bp, Zea mays
  unsure at all n locations
  Clone ID: LIB3088-047-Q1-K1-H2
cccacgcgtccgcccacgcgtccggagaactgcatcttgaggggtctgtgaaaacaacagaattgaagatcacatggctagcagatatagaggagctagttcccctttcattggttgaatttgattacctcatcagcaagaaaaagctagaggaagacgaggacttcctcgacaatctcaacccttgcactcgacgggaaatcccagcccttggagatgcgaacatgaggaacatcaagcgtggagagatcatacagctcgagaggaaaggctactataggtgtgatgccccttttatcagatcgtccaaaccggtggtcctgtttgcgatcccagatggcaggcagcaggcctcgcttagctaggcatggtgaccaccctttngngcacatggaattcctgaagtggcgat

SEQ ID NO: 81351 - DNA, 293 bp, Zea mays
  Clone ID: LIB3088-047-Q1-K1-H3
cggacgcgtgggagaaatgatctatctggctggtgacgaaggctgctgccaagacaaagtgatctatctggctggtgctgtgcttgcttgttggctacctcggggaagctaaaaatatctcgtcttgttgacatccttgcagttgccgcgtgaacaagtaatctatgatggcaatgtttgcctggccatgaagtattattactttcgttgaaaccgtgatgctattaagacttaattttttttatggaccatcgaatgtaaggcatacatggttatgagtttggtcctcccct

SEQ ID NO: 81352 - DNA, 275 bp, Zea mays
  Clone ID: LIB3088-047-Q1-K1-H4
tcgaggccacgcgtccgtccacgcgttcggtacaattcaaggatgctcctggtgacatttttagatgcaagaaacaaggcaggaatgactttgtcatacgcctgcaaccatcataagccatgtacatgaaactaacggtcaaaaaacccggactggaaatagctaccgaacaaagcgaactggatctatcgtatgggatgcggtacaatggcgtcaaaatcccagaagcatacgagcgtctcatcttggatacgattagaggagaccagcagcac

SEQ ID NO: 81353 - DNA, 255 bp, Zea mays
  Clone ID: LIB3088-047-Q1-K1-H5
gtcgaccacgcgtacggaaaggcgaaggaatttagaaagaacgaggcccaggagagtgtcatagctgaatcatatggcgcaggtaatgatgaattgcggcaaaaaaagaaaaagaaatcaactaagtccaagtagccctaatcctcatgcataatgacactggcaattgagaaggattgcatgagccatccctataattatgtcattcatgctgtgatcgtattagatgatgaaacaaaattcgaaccttccgct

SEQ ID NO: 81354 - DNA, 69 bp, Zea mays
  Clone ID: LIB3088-047-Q1-K1-H6
aaaaaaaaaaaaaaaaaaaaaaaaaaaatttatagttctagatcgcaaacaaaacaatctaaaggaggt

SEQ ID NO: 81355 - DNA, 363 bp, Zea mays
  Clone ID: LIB3088-047-Q1-K1-H7
cccacgcgtccgcccacgcgtccgtccactcgtccgcccacgcgtccgcccacgggtccgggacagttggaattcctcccaaaattcttcatcgaagaacaacaattccagttcttgggacgattgggacgaccaaggcaagaagggtgaacctgcgaaaccgcaccaaagcagtgactcctgggctggctgggatgatgggaaggacgatggttttgatagtcctggttacaacaaccacaacagctctaacaaggggagcaaccacaacgggacttccggtggctcattttggagggaaggcggcttccgctgaaaccgttctcttctccatagagttatactttcagagttgttacattg

SEQ ID NO: 81356 - DNA, 249 bp, Zea mays
  Clone ID: LIB3088-047-Q1-K1-H8
cccactcgtccgcccacgcgtccgagcgctacgtgtacaagcgccgcactgatggggtcgacattattaaccttggaaagacctgggacaagcttcagttggccgccagggtcatcgttgccattgagaatccgcaggacattatcgtgcagtctgctaggccctatggccagaaggctgtcctcaagtttgcgcagtacactggtgcccatgccattgctggcaggcacacttctggtacattcacca

SEQ ID NO: 81357 - DNA, 240 bp, Zea mays
  Clone ID: LIB3088-047-Q1-K1-H9
ccgacgcgtgcgctctctcctgcgttccatggtctctcaaaagcgctaccgggggtcgagacatacttaacggtcacatgaaatgcaaccgactatgatggggattctgctgaactgtatgcgttcaaaaggacaactatattgatccgccccaccactgtgcttgtgatcaacctgcttggcataatggctggcgttgcacttgctatcatcacgttgttccaatgcatcacttccact

SEQ ID NO: 81358 - DNA, 423 bp, Zea mays
  unsure at all n locations
  Clone ID: LIB3088-049-Q1-K1-A1
cgctctcgttatgcaattggcattgtcatttttattaagcaatcagatgcttggaatcaggtgtacgaatttgtaccacaaagggatagccttagtttactttcaaacctggaaccgtggcaatttctccaattgagatgttccagtctgtctttacacttgttgaagatgaaatgatgggtgatcctgcatatcttattgctgtcatcatagagtttctacggagtgtctcaaaggctgggcttaaggctcctcacaacctttatgtgatgacggcgacactactagctcgtagcaaccgttacgctgaaatagcattgtttgtgtcaaacaagattcttgagccgtgtaaagaactggcaatgcaacttatggagctgggtctgcagcacccgncaacgaggaagctgggcatggacatgc

SEQ ID NO: 81359 - DNA, 446 bp, Zea mays
  Clone ID: LIB3088-047-Q1-K1-G5
atctgatcccctgcttgatgcggccaaatcgaacttgttaaaagtcctcacattgtctacgaaacggtagaacaagagaagacctaactcctaaggaaattgccactggagcctcagagttcagacacggaagcgcggtcaccaaatctctgttctgaagtgtctcaactgccagctcaaaattgatgcttggtgcctctagtctactgctcattgctcacagagtcacaggtgtaggaagtttcagaagtgcggcttcgaagactgcatttgattttgactgagttgctgcctatatgacaatcaaagctgcacaggctccgaagtggctgtgatgtgttcttaaagagtcgcatcagcgcaggaagagcccagattttgaagttcatgtgtagctaaatttcgatataagcttgaacggcttcccttagctgatgtatatacat

SEQ ID NO: 81360 - DNA, 399 bp, Zea mays
  Clone ID: LIB3088-049-Q1-K1-A3
cccacgcgtccgagtggttgtctgaaggcttttgaactgcttgaagcattagtgtagctggggtgcttttgtgactgatcaactctggagcagctagagtgatgtagttgtgggcttttgaacaatagctggagtgatatgaaacattagtgatgtagttgtgggcttttgaactgcttcaagctggagtgatgtcgttgtggtgcttttgtgactgatctagtcgtgaatgatattataattgtgaaaaaaaaaaatgaaatgaactaaaacatacacctgtataatacattaaaaatgaacactattaatttaaaggactaagaaattgaaactaagaattaggtactgtgaaactaagagtttggtaccgaaaaaaaaagggggtgactttttaag

SEQ ID NO: 81361 - DNA, 215 bp, Zea mays
  Clone ID: LIB3088-049-Q1-K1-A4
tcgctcacgcgttcgaaaaaaaaaaaatacattttttaatttttaaaaaaacaattataaatacgtaaatttgtataaatatcctagagataatttcaatattacaaaaaatcatttcacatactattccattatccaataagtctccctccttgaataaccctcattcctttaaccatgtttccaatttaaattactctatcactattaagctt

SEQ ID NO: 81362 - DNA, 451 bp, Zea mays
  unsure at all n locations
  Clone ID: LIB3088-049-Q1-K1-A5
taccggntcggaatgaccgacgcgtccgctcctcgcatttgttcccatccgatccccccttcgcatccaaaaccccaactcgccccgcatcgatggggcccaaggccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaagccgncaagctcgcgcgctataacaagaagcctaccattaccttccgtgagat

SEQ ID NO: 81363 - DNA, 426 bp, Zea mays
  Clone ID: LIB3088-047-Q1-K1-E8
atcagcaggttcaagcaatcatgtggaggcgttgagagtatatcttctgtcaagggctggttccagattgaagaaccagttccaagctggagagggcatgattacagttgactgcatcgaaggttatccaccggtcagtttactgctaggaaagcatgtttttctaagtgcaggggatttttatctggctagtcgatcctagtttcgtttgctgcatcccaattttgactgcctcacccattgttttgccgcaatcagcttaaaacagcttggttccatttatgcatctcaccgaagtcatgtattcagtaaaggtgaaagtctcaatgtacgcttatatgctatagcatgatatgcatttgcgcccttgggctgggcacatgtaagctaagattttaaaatattcggctatggttcccatatgtg

SEQ ID NO: 81364 - DNA, 420 bp, Zea mays
  Clone ID: LIB3088-047-Q1-K1-E9
ggtgaaattcgtactgtccgagttgccttatatacagcgcagtaccacattgatgttaccgagacatcagagaagggcacagaaaatgtgtatggaacatttaatattctaatgagaaggaaacccaaggagaataatttcaaagcaatcctggaatctatacgtgatctaatgaatgaaacatgtgtagttccagaatggttgcataacatattcttgggttatggaaatccttctgctgcacagtggatgaatatgcctgatcttctggaagttatagatttcaaggacacttttcttgatgccaaccatgttcagcaaagttttccagattaccaggtatatattttgactattttttttttttttgcttttttggagtgtatctattctcattttcatcttcaatctccagtgatc

SEQ ID NO: 81365 - DNA, 352 bp, Zea mays
  Clone ID: LIB3088-047-Q1-K1-F11
gaggcacataaatttgtggtgaatgtagtttcccttgctatggcccgtgatggggctagtggagggtttgtccgtacagttacaataaatgcggattgcgtgaagaggaacttttaccctggcgacaagctacccctgtggcacgacgagcttgaaccccaaaactcgttgcttgatattcttgctgctgggaaccctgatcccatggtgcagtgaactcgccctccacttactttgtgaacttttcactgtatctgacttgttcttgattatttctccctgaactatgtcagaccagagtaatttacgaattgttgttatcgcaccttaataaattcatgtttagctgggt

SEQ ID NO: 81366 - DNA, 400 bp, Zea mays
  Clone ID: LIB3088-047-Q1-K1-F12
gagcatcaagccaggcccgctcccggagctgcccgtgctggcgctggactacggggtgcgggacttccccacgggctacatcgacgggctcaagcgggagtacaaggcgcacagcggcaggttctgctccggcttcgacgtgctcacggccaagctctggcagtgccgcacccgggcgctggccctggacccggccgccgaggtcaagctctgcttcttcgccagcgtccgccacctgctcaagctcgaccgggggtactacggcaactccatcttccccgtcaagatgtccgcgccggcagagaaggtgctggcctcctcgctcgtggaggtggtcgacatcatccgggaggccaaagacaggatggccgtcgagttctcccgcttcgctggggaggag

SEQ ID NO: 81367 - DNA, 314 bp, Zea mays
  unsure at all n locations
  Clone ID: LIB3088-047-Q1-K1-F2
cccacgcgtccgcccactcgtncgcccactcgtntctctccttagttatgaagcacccccatcatgagaatcatgctatttacgttgtaactttaggattttttttttatgtacctgtaggccttttagactcttgtacataagcttctagttttagttcgtttatacggcccatcctgtagttttgatgtagcagctctcagctctgccactgctacaccaacttatggcatgtataagtgtactaatacatggtcatcagcatgatacattctttagatgcttggtcaattttttagatgcttggtggtggc

SEQ ID NO: 81368 - DNA, 370 bp, Zea mays
  unsure at all n locations
  Clone ID: LIB3088-047-Q1-K1-F3
cccactcnnttcttgacgccttttcggactcgttttcataactactacaacggctcactggaaaggtcaaaattgttgactggacggatgangaattagagcaaacttcagaggcagttggatatggtgctgtgaagtatgctgatctcaagaataatcgtctgactaattacacatttagttttgaacaaatgctgagcgataagggaaatactgctgtgtaccttcagtatgcacatgctcgtatttgttccattattcggaaatccaacaaggatgtggaagatctgaagatgactggagccatttctcttgaccatccanatgagcgtgtgttggggctgtatcttatccgatttgctgaggtggt

SEQ ID NO: 81369 - DNA, 346 bp, Zea mays
  unsure at all n locations
  Clone ID: LIB3088-047-Q1-K1-F4
ttcatataaaaaaaaaaaaaaaaaaaaaattaaaatttaaaaaaaaaaaaaaaaaaaaaaagaaaaggaaaaattaaaaaaaaaaaaaggaaaaaaaaaaaggggngnnnntttggggggtccctatataaaatcccaatttactgccccgtccatccaccgtcatagctctcctaaacccaaccaaaatccatccactcccacccttttaacaacaaaacccctggaaaaccccagcctatccccaactaaaaccccccccataacacccccctttttcaaactgaaaaaaccccaaaaaaccccccccccaacccctttcccaacatttacccaacctaaaacc

SEQ ID NO: 81370 - DNA, 423 bp, Zea mays
  Clone ID: LIB3088-047-Q1-K1-F5
cggacgcgtggtcggacgcgtgggcggacgcgtgggtttttttttaaaactaaactaagggcacgtaaaaataaaaaccccttaagaaaatagggttctcaaaatagccctaagaaatgcaagaaatccggcacgttacacttctgtccacaacatagctttttgcagagattcagtacataaggattcttcaaattaaccataccacaccataacatgggacatttgcgaaactacgggtacaggtatcaaaatgcaacgagttcaatactaaaatataagcgtagtgcaatctaatcttcttcctcgccctcgttctcagcaatgttgaagtagcggagctcatagacgtttcggtccttgttggcagcaaccacgcgtagccaatcccgcacgttgtgcttcttcaagtacttcttggtc

SEQ ID NO: 81371 - DNA, 321 bp, Zea mays
  unsure at all n locations
  Clone ID: LIB3088-047-Q1-K1-F6
ctgagttggtaatatcctagattgcctgttttacatcanaaaaaaaaaaaaaaaaaaaaaaaaaagtgaaaattaaaaaaaaaaaaaaaaaaaaaaaaaaaaaaaaaaaaaataaaaaaaaaaaaaaaaaaaggggcggcccttttaaaaaatcaaagtttacttacccgtgaattcaacgccataacttttctataaagtaaccaaaattaaataaactggccgccatttaaaaactgtttaactgaaaaaaccctggcttaaccaaactaaattgatttttaaaaaatccccattttaacaatttgcttaaaaccaaaa

SEQ ID NO: 81372 - DNA, 344 bp, Zea mays
  Clone ID: LIB3088-047-Q1-K1-F7
caacttctttggagttctggccttgcttgtcttgatgtctactctttgaagactgaaagagatcttcacaaccctgtgcttgtaagcctttttgttgttggggactgggtcactgcaattctgtcgtttgctgccgcgtctgcgtccgcgggcgtgaccatcctgttcgagagggacgtccacttctgcaggatgtacccgcagttgtcgtgcggccggtacgcgctctcggtggtgctggcgttcatcacctggtccttcatcgcaacttctgctgtctccatgttctggttgctgccgtcgctctgatgtggcacggaaagagcctgccgtgtcgtcctgtt

SEQ ID NO: 81373 - DNA, 349 bp, Zea mays
  Clone ID: LIB3088-047-Q1-K1-F8
gtggaattgccaaagctggagcaaagatgtgtcatggcagtttcctgtgctaaggttcctaaaattacaataattgttggtggaagttttggggctgggaattatggaatgtgcggacgtgcatatagcccaaactttttatttctttggccaactgctaggatatctgttatgggtggcatccaggcagctggagttctcgctcaaatagaaaagaacaacaaaaagagacaaggagtggagtggagcaaggacgaggaagaagccttcaaagccaaagtcgtggaggcttacgacagagaaggaagcccgtactactccactgctaggctatgggacgacggggtca

SEQ ID NO: 81374 - DNA, 351 bp, Zea mays
  Clone ID: LIB3088-047-Q1-K1-F9
cggacgcgtgggaaaaattgagaatgcttgcttcagtgttcatgtgagaggttcagagtagattcctctgctagaatcatcagcagatccaggctattcttattttggtgccccggactttgatcaatgaatgttttgaagcaagaactaactgagtgttaaaggagcttagatcaatttaaggagagcggttgtgtcaaggctactcttaggtccacagttgggtgtttgattttatcgccagtttatgttgcacatcttgaagtctgtaaatctaagccccaacgtggtaatccgggagaatcatgttgcaatacaacctttttatggtgcaagactgtaatactcaaa

SEQ ID NO: 81375 - DNA, 94 bp, Zea mays
  Clone ID: LIB3088-047-Q1-K1-G1
cggggcgaaccaagccttccgccaacccttccgccaacccttccgcggacgcgtggaaaaaaaaaaaaaaaaaaaaaaaagggaagggttaatt

SEQ ID NO: 81376 - DNA, 367 bp, Zea mays
  Clone ID: LIB3088-047-Q1-K1-G10
cggacgcgtggggagagaaggaaaaatattcccaaaccctacctcccgatctcgatgggggaccctcgcgtcttcttcgacatgaccgtcagcggcgccccggcgggccggatcgtgatggagctgtacgccaacgaggtgcccaagaccgcggagaacttccgcgcgctgtgcacgggcgagaagggcgtgggcaagtccgggaagccgctccactacaagggctccaccttccaccgcgtcatccccgagttcatgtgccagggcggcgacttcacccgcggcaacggcaccggcggcgagtccatctacggcgagaagttccccgacgagaagttcgtgcgcaagcacacctgccccggggtgc

SEQ ID NO: 81377 - DNA, 310 bp, Zea mays
  unsure at all n locations
  Clone ID: LIB3088-047-Q1-K1-G12
aattccgaggccacgcgccacgcgtggcggtacaccatacctttgcgccatccacgccttgcgcgtcactatcatgcccaaggagatcgcgtctcgctcggagcatcacgggccanagggcttgagcgcccgtcgtgctgctcgtcgttgtagtgttactagaagtagatggtggctttcgtttcgtggcttccttatcctgtaggagtaatgttctagatgtcttggcttcagtgcaatggactgtgtttgctcatttctgaaatttatcaatggacttgtaaaaaaatataagatgtgccaacaccca

SEQ ID NO: 81378 - DNA, 321 bp, Zea mays
  Clone ID: LIB3088-047-Q1-K1-G2
aaggctcttgaacacacgcgtatcgtgcagaacgccgacccttccggcgtgtacagagagaggtagatccatctaagcttctgtcgcagtgtcacccgagctgccccaccccaaactgtttggattagcgtctgtttgatgggtgggccctgggacgtgacttgatacggcaaattgccctatactgatgtatcctaccctgttgaacaatcttcttgcctctctctatatatatgaatatgaatgtacatgttctaagcctctctgaagatttttgtaacatattcaatatgacagccaatattagccctaaaagagtct

SEQ ID NO: 81379 - DNA, 368 bp, Zea mays
  unsure at all n locations
  Clone ID: LIB3088-047-Q1-K1-G3
agcatctacgtgagtgatcagaccggtggcccgccgatgataggtgtcaagggaaggacgaaactggagctgggagcctatcgaaccatcctgtatccgctatatacagcatatcctgtattcccacagtgaaaaggatgcacctggtccttctnngttcccagtttggtggaatgcacccttctacggtaagtaatcaaagcggctacgtgttcaatgcattgctgnnncgcatcttatctgctagttagaaatcaaagcttgtcataccgttcgtaaactgaggacaaactgannaaatggaatggtggcatcagggaggttgtattntggtacgggcttgccgaagggtcaaaggctagggtgtg

SEQ ID NO: 81380 - DNA, 395 bp, Zea mays
  Clone ID: LIB3088-047-Q1-K1-E7
gaaagaagcaaaatactgtgtcatgggagcatgaggatgttgaacttttggcaagggggcgccatgacccctgtgttgtccctcgagctgttcctatggtggaatccatggctgcgctggtcctgatggaccagctcatggcgcatattgcccagtgtgagatgtttccgctgaaccttgccctacaagagcccattggctctgctagcagtgcatctgaactgtcaccaaacctatcataatgtttgtcgtggaacatgtcccagctttccttctatcgaaattctggtctttgctaagcagtttgcaattcggaacccccataaaccctcgactattgtacctagagataaagtgaacggatatcaagatagaaatgcattaatgtttttgtg

SEQ ID NO: 81381 - DNA, 298 bp, Zea mays
  unsure at all n locations
  Clone ID: LIB3088-047-Q1-K1-D12
aaaaaaaaaaaaaaaataaaaaatttactttctaaacaaaaaaaaaaaaacacaaagccaagttaaaatttaaaactacgcaagccccacccaanaaatcaactttacaaatattaatatacaaaaaatcctatcccctttcacatacacatatcttaacactatccacatctaaatcatctatatttttcccttatcccctattttaatttcattatcccctttctaaaaaccatcataattaaaaaacccttttctttccccattttttatacttttcccccctccccattttccc

SEQ ID NO: 81382 - DNA, 359 bp, Zea mays
  Clone ID: LIB3088-047-Q1-K1-D2
acacgcctcgtcctcatactacattcacgtctgcatgcgccaactactcctagcctacggagggtccttccagaagcgcaggactctaaaagccctcgacttgccattatccctcgccgaggaggtctactgatatcacataaacaatgacaacaggctgttgctatgcttgctagcataccatcgtgtcaagggcaccatctttttcacccaatagggagatggccgtaccactgtcaccggaagtgtctttggcctgaagactcggcttcatggtgtccatgtacactcactctttgacaccaccaatggatgcatgataactggaccacactacattgatgcgagcaaggagcatg

SEQ ID NO: 81383 - DNA, 384 bp, Zea mays
  unsure at all n locations
  Clone ID: LIB3088-047-Q1-K1-D3
cggacgcgtgggggtccccgcccgagcacatctcgcgcgccatcaangccgggctgaaggacaagggcctcgacgccatgctggcgctggttgaggacgagacgctatcgtcgttctcctccgcgtcctcgtcgtccgacgaagaggcaggccggacgcagctgaggcgcccgtcgtcggggagctacgggcggcggtcagccgaggagccggtggtgtgcagccccgcgagctcgctggtggccgtcatggtgcatgccctcgcgcacagggtgagctacgtgtgggtcctcgacgaggacagcgactgccgccttgctggcatcgtcacgttcgcggacgtactgaaggtgttccgggagcagctgctgtgagatctggaag

SEQ ID NO: 81384 - DNA, 285 bp, Zea mays
  Clone ID: LIB3088-047-Q1-K1-D4
ctgccaaccactttcaccgccaccgtcgagcgcggtggcaccgacacgacacacgtagctgcagacctgcagtgccagcacggctgccaatccctgctggcgctgttcccggctccgagatcatttggactcggcactcggcagggatggggatggggacggaatggccgccgacgcctgcgcagcaaaggaaagcggtggtgagcgccgggtcggcgctgaagctggtactgttcgtgattctcgcgggcctcgcactgcggctgctggtgggggccccagcct

SEQ ID NO: 81385 - DNA, 377 bp, Zea mays
  Clone ID: LIB3088-047-Q1-K1-D5
ctgtccactacttctcccacaacaaccttttgcatctggacgcccgcatctctcgtctgggcagggatgcattctaagatgtgctggcaatccctcgttcacctcctcaagtatgacaactcctacagactacggcactcctgaaaccgtgaagtttggacgcatttgccgaccactcctgaactctgaccgaccaatcttctactcgctttgccaatgctgcttcatggaatgtcccaaatggtgcggcatgtaccgcaacagctggaggaccaccgcccaacataactacacatggtcaaccatgctggacaacatctacctgaactactcctacgcccggtacgccaaaccccgctgctggaacgaccctgaca

SEQ ID NO: 81386 - DNA, 446 bp, Zea mays
  unsure at all n locations
  Clone ID: LIB3088-047-Q1-K1-D6
cggacgcctggtgcaggtcatctctttcataccctacacggccacacggcatgtttcaggggcaggtccagattccagcagctctgagctatanaaaaaacggcttgggggcgagacggagagaggggtatttgcagtataagtacctttggatcgaagagcatcactcgaagatgcatcgaggactgttcttcttcttcctcaagctgtagcctgtgggaggagaggccggagaggcctcccatggagttcccccactcatcacttcttgttggtcccctgctagctgttcgttccctcagcaggtagctagagatgatcttgctttaaatttgtgctgatctcttcctcgtcgtgtacgctcatatgcatggggcgacggatttgtctctgatcgttcccatgccgcctcttgtatcttgacttggatctatatatcaatgcaa

SEQ ID NO: 81387 - DNA, 428 bp, Zea mays
  Clone ID: LIB3088-047-Q1-K1-D7
cttcgacatagacctcatggagcttaatgttacagtcaaaggcaatgtcaagccggagggggtctttcagacggtttgcaagtctgtgaagaggacctcctactgtgagggcgaagccacggccccggactctgcggcgtctccagaagccgaagcagctcccggcaccgcggcagaagcgcctcctgctgctgctccggctgcgccagagatcaccccatccaaagctgacgcctgatcgtcacgctattattcactcacatgtgatgctgcggctgcgactcctaaaccttaaatctagaaatagctggggattgggtttgcattgcatcgtgttcttgccggtctagcaagtgactataagaataatggaataaacgatgacccattgtgtgtatgatttccattctgaaaaacaacacattcct

SEQ ID NO: 81388 - DNA, 440 bp, Zea mays
  unsure at all n locations
  Clone ID: LIB3088-047-Q1-K1-D9
gcggcgcgcggcaccgaggtgttcgataagtctcagccggatgggcgcacgcgccagggcttgttcttcgaccctgacggcaatggcctanaggttactagcgctggtgcagggaatgagaagtgaacagagaccatgatttgcagtctacttctgttttatcgtgcaatacctcagcaaaccctgcctacatgatgcgatcgaaaccggagacgttcctgggtcaagcttcgttccgtaaaataaataaatccgaagcacttcaaagctctacatactcgcccttgcttgtttgagacaagggcttgcgttcttgctgcatctcatccgagatgattgtaatccgaacaatgtgtagttaataaaaatgtcgctttgccctgaaaatgttttacgctgtaaacatcgctctgtacgtgattggatttcctacatgacaa

SEQ ID NO: 81389 - DNA, 273 bp, Zea mays
  Clone ID: LIB3088-047-Q1-K1-E1
gaagaaaataacaaccttcttcgtcaactataaagcttcaattgaagaaaagtccctccgtcttaagtttggttgactactataggacatgcagccttgtggtagctatagtagtagtagatatttatagttgctctagatttgaagttataggattatttttaattatgtttaatgtttaataatttgagttgaagttataagatttgctttgaattttaagttaaaggatttgagatatatggtttggagttatatgattatttgatgggg

SEQ ID NO: 81390 - DNA, 423 bp, Zea mays
  unsure at all n locations
  Clone ID: LIB3088-047-Q1-K1-E10
cccacgcgtccggtgtggcttgtgcttttgaacttcttcattaagatagtcacggcaagggcacaggattatctcaaaaagcagcaggatacggagatggaacttatttcggattccccgatccaggaccattctaaaactaactagtggcgcagctagtggtgtttatacacagctgctagcagcaaagattctcctctgtagcttaagcccctgcagatgatttcaagttccaacaattagtattagtagttattcatctgcgcagtggacaaaaacatggacacatggtcttggttaacttgtcagttgacgaccttttgtcattgagcctgtacctgtactggcagctcctgttggagtcattctgtttattttcggacatctacacggataaacagtanngaatngttatggagcacg

SEQ ID NO: 81391 - DNA, 67 bp, Zea mays
  Clone ID: LIB3088-047-Q1-K1-E11
cccactcgtccgaaaaaaaaaaattatatttaaaaaaaaaaaaaaaatgggcggccggctcgttata

SEQ ID NO: 81392 - DNA, 424 bp, Zea mays
  Clone ID: LIB3088-047-Q1-K1-E12
cccacgcgtccggaattcttgattttgtttccaacgaaaactcagggcgtatgggtgagggccaaacatttacaattgaacctatactcacaatggagaaaacagagtgtgttacatgggaagatggatggacgactgtcactgctgatggtagctgggctgcgcagtttgagcataccatactggtgactagggacggtgcagaaatactgacgaaagtctgagctattctcctgcccgataattattgtcagaattctcagctatggttcctgtcccaaggcatcctggtcatgtccgttgctcgccgcaatactcatttcagagttttgagatctgctgcaggccgacatacgggaaaagtttcccccatgtagcagcaacttgcaggtgataggtgagggcacacacacacacagagaca

SEQ ID NO: 81393 - DNA, 347 bp, Zea mays
  unsure at all n locations
  Clone ID: LIB3088-047-Q1-K1-E2
gttctagatcgcgagcgccgncctttnttttttttttttttttttttttttttctcttcggtttggttttngaaaaaaaacataatgagccgacttttaagttcaaacatcaaacttcacaaggattcaagccattctgctgcaaaagagttttgggtacaacacaaaggacacaacaggtccatttaaccaacgaatccacaaccacgtttcatgacacacaaaccacagtttttttttttacgacgacgacgcaaatacccaggtacagcagctgcttaaatgaaccatggcttactgaccaccacggaggcggagcaccaggtggagagggctctccttctgga

SEQ ID NO: 81394 - DNA, 408 bp, Zea mays
  Clone ID: LIB3088-047-Q1-K1-E3
ctagttctagatcgcgagcggccggcgacacgctcttcaacgccgtgccggggctggacggcgcgccgggctccgtgtccctggagcttgccaccaggccggggtggttcgtggcgacggcccccacagcgatgcacgcgaacgccaccacgcaggtcgtctgccgagccaacaagggcggcgcggcgttccggcgagcggcgagcttcgcgcgcgcgccgccgctgaggcgttaccacccgctgagcttcgcggcgcgcgggacggcgcggaacttcctgctggagccgctgcggagcctgcaggatgagttctacaccgtctattttagcctcgtctccgacggcgagagctgattgatcggtgtgctcctgaacgaacgctccgctagtttcgctgtgcaatgag

SEQ ID NO: 81395 - DNA, 219 bp, Zea mays
  unsure at all n locations
  Clone ID: LIB3088-047-Q1-K1-E4
gngcaatcggtttgtgtagtagtagtgtagtactagctagccagtttgcctgtgcactagccacgagccaatttgcgacttcgcaatgcaaatcaagaaatcgacgggcaaatatttttctcctgcaaaaaaattgcagtgccatgccatctcctaagactattcacagcggcttcatctaaattttacccctataccacttttttatgtcaaannana

SEQ ID NO: 81396 - DNA, 402 bp, Zea mays
  Clone ID: LIB3088-047-Q1-K1-E5
ctcctgctgtcccaactgagcggtaaggacatcaccgagctcattgccgcgggcagggagaagggggcttcagtcccatgtggtggcggtggtgtcgctgttgcggcagcttcacctgctgctggcggagctgctcctacagctgacgcaaagaaagaagagaaggtggaagagaaggaagaaagcgatgatgatatgggcttcagcctcttcgactaggctgcacagtcatcacagtattgtttcgggcagtgaaaccagaggaaaaccagagtcatgtttagattttaaccttgctttatgttggaaagtactgctacttgtctttatatttggtaattcagccgtaagttgctatgctggttgggatttactcgggaaccagagtttttctatcttata

SEQ ID NO: 81397 - DNA, 318 bp, Zea mays
  Clone ID: LIB3088-047-Q1-K1-E6
cccacgcgttcgcggacgcgtgggcgcggtcaacggccggagtcccggcggtttggttggcgccgcgcgttgccgacttgtgtgcttcgggtgcgtgcgtgtgtggtggggtacttttcacactatattggaaaaagaagctattatatatctttgactgaaaaaaagtgtcgttgtataattatcttttttttcgtgtccgtgtatgcaacccctcctctcatagacccatagcgccaaatagtcatccaatgaatattctatctgactctttgtatacctctctcttagtttaaacgggctatctattctttactc

SEQ ID NO: 81398 - DNA, 418 bp, Zea mays
  Clone ID: LIB3088-047-Q1-K1-D11
cccacgcgtccgggctgctgctgtccttggtgatagattctactggtggattgagccaggtggtgcaattgttcttgcagtgtacacgatttcaaactggtctggaacagtgtgggaaaatgcagtatcgctggtaggtgaatcagctcctccagaaatgcttcagaagttgacatatctggctatcagacaccatcctcagattaagcgtgttgacaccgttcgagcatacacctttggggtgctttactttgttgaggttgacattgagcttccagaggacttgccacttaaggaggcacacgccattggagaatctctccaaatcaagattgaggagctacctgaagttgagcgagcattcgttcacctagatttcgaatgtgaccataagccggagcattcaattcttaacaag

SEQ ID NO: 81399 - DNA, 65 bp, Zea mays
  Clone ID: LIB3088-058-Q1-K1-H6
acccacgcgaccggccaagacgagcagaaacggaggcagcgaggcaaggccggagagccagcacc

SEQ ID NO: 81400 - DNA, 272 bp, Zea mays
  Clone ID: LIB3088-058-Q1-K1-H8
acccacgcgaccagccaagacgagcagcaacagactcagcgaggcaaggccggagacacagcaccgagacagggcaaccatgccaggggggccacggacagcaagaacccaagccagccacgccacggagaacacgccgaaggcgaacgaccagagaacagaaggcgacaacgggacaacaagcaagcacagggagcaaggcgagagcagaaacgagcgcaagcccaagagccaaccaacaacagggcccaaaacaccaggccaaacaaaaa

SEQ ID NO: 81401 - DNA, 245 bp, Zea mays
  Clone ID: LIB3088-058-Q1-K1-H4
acccacgcgtccggccaagacgtgcaggaacggagtcagcgattgcgaggcgcgagagccagcaccgcgacaggacgacctcccagggcgccacggagagcatggacccaggcgagccacgccgcggggaacaagccgagggcgtccgacgggagcagaaggcgacatcgcgcaacaagcagggcgaggagcaaagcgagagcacaaacgagcgcaagcccaagagccacgcgaggccgggccca

SEQ ID NO: 81402 - DNA, 354 bp, Zea mays
  Clone ID: LIB3088-058-Q1-K1-A2
acccacgcgtccggagaaccgcgagacgcgctacgtagcagagtacaaactaaaagcagccgcaacggcgagcggcactatatggccgggcacaggagggtcggcaggcggcaaggccgggaacgagccgacggcggccgcctccggcgaggcccgcgagacgaagcgcaagacggcggcgaaggccaagccggcggcggcgaccgggagcccgaggaacggccccgaccgcgagcgagaccggggcccacgggccggagagccggcgagcaacccgacgggcgagtacccgggcgacgacggaagggacacccgaggggcagtcggcgggaccggggaccggcgccaagaacc

SEQ ID NO: 81403 - DNA, 345 bp, Zea mays
  Clone ID: LIB3088-058-Q1-K1-A3
gacctacgcgtccggtcaactttgggcatatcgggagctaggatgcaggtttctgccatggtctagtttttggtcttgttaccctttgtgcagggccgtttgcaggtgaaggtgatattgctgcaccatctgggagaggaggggctcatcagtacctgagagagctgaaactatgtaaattatctgaccgcgaatgagtacggccagtgttaagccagtaaactggctgcatgttggtccatagtagttaatgtaagaatgtagctggtggagactggttaatgcctagggtcgtttctagttgataccagtattttgtaatgtaatgttctgtcggtacttccc

SEQ ID NO: 81404 - DNA, 147 bp, Zea mays
  Clone ID: LIB3088-058-Q1-K1-A4
ctcagacgcgcgatgagcacagacgacggttacgaatttcagccactacatgaccgcaggaacaggtacgggttcaaacaggggacctagacactcagaagacgaggagccagtacgactggctcaactggcgaacagaacaccctg

SEQ ID NO: 81405 - DNA, 224 bp, Zea mays
  Clone ID: LIB3088-058-Q1-K1-A8
accacgcgaccgccacgcgtccgggaacagccatcacagatgagcagaacacaacagcgacagggccgacggccgaataagcggggagcagcgcgacggcaccaaacccgacacagaagacgaaggaccccagaacagcaacccacaggaccagagaagaccaaagcacaacaggcacacacggcgcaagggcaaacaggaaccgcaacaagaaaaggaggaag

SEQ ID NO: 81406 - DNA, 427 bp, Zea mays
  Clone ID: LIB3088-058-Q1-K1-B1
gtaccggcctgaatactcggccagacctacgcgtccgtccacgcgtccgctgacatttacagatctttatttatttatagtgtcccttcatacacagtaatgctcatacttattatcgggtattccaatccctcctctacatagatacaacaaatctaatttgttccttcctaatatcgtatattggcatgttcactcattgtttgggagcatcacaattcacaaactcctttgcacatgttgcaacttttactggatcaggtatgatatcccagaaaaaaatgtaccttgctttgttatattacttgctaatgcacccaactattctaccttttgcatatatatattacttgcactgcgtataaaatacttggttagaaagatataatattccttatcggttatatttacaagatggtttaatgcg

SEQ ID NO: 81407 - DNA, 145 bp, Zea mays
  Clone ID: LIB3088-058-Q1-K1-B3
cggacgcgtgggcggattcgtgggcggactcgtgggtttacctgataaaacaaacactagccgactagttcattcaggctggctgagctaagacaggatgaataacggctggttgagctcatgcatgacatttatttgggttgat

SEQ ID NO: 81408 - DNA, 267 bp, Zea mays
  Clone ID: LIB3088-058-Q1-K1-B4
ctgcgcaccaagctgccttcggagcaccgctactactttccggacagcgagaccgcggaggccgtcatggccaccttcacggcggtcttgacgcggggcttcgccatcgaggtgctcgacgatcacaacggcccgtccaggatcgacttcaagttccgccactggggctacatggaggggcccttcaagggccacccgtcgcacggccagcgggtcgagctcttcgcgtctagatctaccatgtcgactaatacatgaatgtggaca

SEQ ID NO: 81409 - DNA, 358 bp, Zea mays
  Clone ID: LIB3088-058-Q1-K1-B6
gggatgcgtacgcgtcggcttctcaggcgttggaagagcaagcacatctccaggccatgtaccctgtcatggaggatgatagcaacttgaggacctatcctagacaacgtagccgtcaagaagctgttcaccccacacaaaccaaaggataacggggtgctgaatggagactctgaagagaggtccatggatgttccccaacacgagctctgggagaagctatgtccaactaaccttgacgagcaaacgtatgtcttacctgggtggatgaacgaatcaaaccgtgccgacgttacattaactctgactgagttctaagttcccaagggaaagcgtgccattgagcttctgtcaggct

SEQ ID NO: 81410 - DNA, 304 bp, Zea mays
  Clone ID: LIB3088-058-Q1-K1-B7
gtccaccgttcctgtcaagattgttgagctattgagaagatcttgacccacaacagtttgggcatcaactaggagatcctttccaacccggagttccttgcagagggcactgctattgaggacctgttcaagcctgacagagtgctcatcggtggccgtgagacccccgagggcaggaaagccgtccaggctctcaaggatgtgtatgctcactgggttcccgaggacaggatcctcaccaccaacctgtggtccggtgagctcttcaagctcgccgtcaatgcgttcttggcacagaggatct

SEQ ID NO: 81411 - DNA, 146 bp, Zea mays
  Clone ID: LIB3088-058-Q1-K1-B8
gctgcccctctgttatggaagatctggcgtttatgctcagcaacttggcgtagaaaactgttcagtttatgagcatcctaggagattctcaatcttttggtgcttttgccagttgacttgactgcgcatgtgccgctctgcaccaa

SEQ ID NO: 81412 - DNA, 429 bp, Zea mays
  Clone ID: LIB3088-058-Q1-K1-C3
cccacgcgtccgctcgcattgtccttgcattcgagagtttatccccctcccaaccaaaggccgatggcgcccaaggccgagaagaagcccgcggcgaagaagccggtggaggaggagcccgcggccgagaagacgaccgccgggaagaagcccaaggcggagaagcgggtccccgctggcaagtccgccggcaaggagggcggcgagggcaagcgtggcacgaagaagggcaagaagagcgtggagacgtacaagatctacatcttcaaggtgctgaagcaggtgcacccggacatcggcatctgctccaaggccatgtccatcatgaactccttcatctacgacatcttcgagaagctggccggcgaggccgccaagctcgcgcgctacaacaagaagcccaccatcacctcccgggagatccagacc

SEQ ID NO: 81413 - DNA, 253 bp, Zea mays
  Clone ID: LIB3088-058-Q1-K1-C6
cggacgcgtgtgcggacgcgagttgaaaaaataaaaaaaaaaaaaaaaaaaaagaaaaaatgtaaaaaaaaaaaaagaaaaagagaaaaaaaaaaaaaaaaaaaaaaaaaaaaaaaaaaaaaaaaaaaaaaaaaaaaaaaaaaaaaaaaaataaaaaaaaaaaaaaaaaaaaaaaaacaaataaaaaaaaaaaaaaaaataaaacacaacaaaaagcaaaaaaaattaaacaaaataaaaaaaaaaaaaacaa

SEQ ID NO: 81414 - DNA, 331 bp, Zea mays
  Clone ID: LIB3088-058-Q1-K1-C7
gcactggtcatcaccatgatcttgtagctctgtaggcatagccacctgtggtcagcagcttctgccgtgttgttagaataaagttggtggcgatcgatcgatctgtggtgatgagtgtccctatctgtgtgtttgtgtttagttccagtcgtctgtgaggaagtcagttatgtttgagtgagaggggtacttcgctcttcggcgaacactgtacttgtcatgaggagagttttcatacccggtgtgtaggaactctgtactgtactctgatccttcctttttcatcgaagtgggttttattttattcaatttttattactttattattttt

SEQ ID NO: 81415 - DNA, 254 bp, Zea mays
  Clone ID: LIB3088-058-Q1-K1-D3
aagcagctctttgtgcttttgaagaagctcgctgcctccggctagtttacgagggtgaagagctcctggaagctgctggccaccgactccaagcccaaggccgccaagcccaaggcacccaaggccgcgcccaagcccaagctctcagcgaaggcgaaggccaagaccgctgctaatcccaaggcggtgttacccaaacccaaggccaatgccaatgtcaagcctgtcgcttctgccgacttgtttcccaagcc

SEQ ID NO: 81416 - DNA, 387 bp, Zea mays
  Clone ID: LIB3088-058-Q1-K1-D7
ctgaattaccaattgatcccattaatgagttgattgaatctgacaagactggagatgatttgaacccacatccggactatggccatctcacaccagcagagcgacgctacatggaacagaagcagaagatcgacatgcagaagatggccaaagtcgccaacaagtcgcatagagaccgcatccaagacttcaatcaagatctcgcaaacctaagcgagcactacgacatccccaaagttggccctggctaacatagccaaactggctgtgttacgcacaacaattgtgtgctgggtctatccatttatgttagcatgttacgtatcgattaaaacgatttgttgccaccagaagttgatatttaatttcaaaagcatgttccaactt

SEQ ID NO: 81417 - DNA, 88 bp, Zea mays
  Clone ID: LIB3088-058-Q1-K1-E5
ccgaaccggaccacccggccccgacccacgcgaccgcccacgcgaccgcccacgcggccgcccactcaaccgcccacgcgcccgaaaa

SEQ ID NO: 81418 - DNA, 142 bp, Zea mays
  Clone ID: LIB3088-058-Q1-K1-E7
acccacgcgaccgcggacgcgttggaggcaccgatctagaccatacagcgacagaggagagacgggcagatgggaaactaccagagggcacgggagatacaacaacagaaaagaccgaagccgaccagaaaggggaccgcac

SEQ ID NO: 81419 - DNA, 425 bp, Zea mays
  Clone ID: LIB3088-058-Q1-K1-A1
gatgaatttgagaagtacgataaggtgcatttcatccgacctaaaatggtgtcagtgcttcgtgttttgtttgcacacatgaacttgacattttctatcggagggcagattagttttgatgtatttccccaaggttgggacaaatcttattgcttgagatatcttgaggaatttcaagaaatccatttctttggggataagacctactagggtggcaatgactatgagatatttgaatctgaaagaacagttggtcatacagttaccagtcccagtgacacagctcagcaatgcagatctctctttttgtcttaagtgatcttcagcttattttcaacacatatttattaagtcatctttgactgaatgcctttttggatttttttcaggacaattcattgctaccattttttctttgaataatt

SEQ ID NO: 81420 - DNA, 427 bp, Zea mays
  Clone ID: LIB3088-058-Q1-K1-F1
acccacgcgtccgcggtcgcgtgggcggcttcgacgtcgcgtttcatcctttggtttctttccccgtcggcggctccttttatatattttggaggccgtcgccgccgctgacccaggttgtcttgatggcgcccgctgtagaagccgtgaaggagacaggctcgatccagaaggttcctgccttgaacgaaaggatactgtcatccatgtccaggaggtcttgtgctgcacacccttggcatgaactggagataggtcctggtgctccaaccatattcaactgcgatattgagatactcaggggcatcaaggttatatatgaacttgacaagaaaactggactgatcaaagtggaccgggtgctgtattcgcaagtgtgacccttacactatggatctattcctcggactcttgggaagacagtgat

SEQ ID NO: 81421 - DNA, 60 bp, Zea mays
  Clone ID: LIB3088-058-Q1-K1-F6
tcgtccacgcgttcgtgagcatctatttgcacctatccaagtgaaaggtgatgtggcatt

SEQ ID NO: 81422 - DNA, 333 bp, Zea mays
  Clone ID: LIB3088-050-Q1-K1-G7
acttggacgcgtgggaaaaaggccggcgactacaccatcttcatgggtcttgaggagtactagggctaggacctaatgacatacggcttccgcgaggacatctggttccatgtagataagatgtcctctgcacatgtgtatgtgagattgaataaaggtcagtcaatggatgacatgagtgagggtttgctggaagactgtgcgcagcttgtcaaagctaattccattcaaggtaataaagtcaataacattgatgtagcttatactccatggtacaatttgaagaagacgccttcaatggatgtgggccaagttggtttttacaaccctaaa

SEQ ID NO: 81423 - DNA, 438 bp, Zea mays
  Clone ID: LIB3088-050-Q1-K1-G8
cggacgcgtgggcggacgcgtgggcgccgccagccgcccccgccgcgacgtctagccacggcagcaccgtcgagtcctggagcggcggcagcggcggcggcgcgcccgtcgggatcctccgcgccccggccgccgaggaggactgccgcagctactgcggctcctcctcgtcggcgctctgcgaggacggcgcgtcgggcccgggctgtggcgacgagaccgccgcgccgccgcggtgctccccgcttacgttcgacctgaacgtgccggaccccgcggccgacgagatggactggcgctgcgacacgctgctgcacctgtagccgcgaacgcgaagcgagcactcagcataactgctgctatcgtgctatgtctgcatagaaatcgatagcctaaattttttctctccaccgcttctttagtcccactctctctctt

SEQ ID NO: 81424 - DNA, 441 bp, Zea mays
  Clone ID: LIB3088-050-Q1-K1-H1
cccacgcgtccgcccacgcgtccggaaagatttatcagctgatttacaaaaagtcacagatgagtacatgaaaaagatcgaatccatccagaagcagaaggaacaggaactgatgaaaatttagacctcaagctgactgtatggctggtgaggagtaaccgcctccgtgaagcatggacccctgcatatgttggtgtttctgaagcaatttgtttggttcatggctttggcgtctcggcgctgcgccagggatgcacgttttgaatcaggcgctttgctggaacttttgggtgcacacaagttgagacaatgctgctgctgctgtgtgtgtgtgttttgagattaagacaatgctgctgtgttttttctttgagattaagacaatgctgttgcgtgtgttcttctcgttttctgtaatgttcgtaaatagtctcttcgtcg

SEQ ID NO: 81425 - DNA, 337 bp, Zea mays
  Clone ID: LIB3088-050-Q1-K1-H10
aacacgcgtactcccacgcgtcctggcactcgtccggctaattgactagacatgagagtgcggatcaggtatatgatacgagacagagaggcatttacgatgattgagagctgcatggtcatcatggatatgatccagggctgcacgaaacgcgcatttaagatcctatgggctacgtacatgacatcagcatgcacatgtaaccatgagatgtataggataggtcagattaacctaatctatgatcatatatactagaatacctgaacaaatcttaagatcttgctaaacaactgtatcctttacataaaccattacacgatgcacgatcatcaca

SEQ ID NO: 81426 - DNA, 337 bp, Zea mays
  Clone ID: LIB3088-050-Q1-K1-H11
accacgcgtacgcccacgcgtccgcccacgcgtccggtgaagtgttcggatcgcggtgacggcatctcgtaaattataggagaaaattctgattgtactacgatccatagctacattattatcctgtataatatgcacatatgcatgggatccgtattttatagctgatgggttctgttgctcacaaccttttgtatatctcaccatcatatatatagatagtgcatattaccctatgatactattatccacgctggaatggattatcaaatcttcattaaatggttatccaatcaatcttttttttaatctatttttttaattattatcattactt

SEQ ID NO: 81427 - DNA, 452 bp, Zea mays
  Clone ID: LIB3088-050-Q1-K1-H2
cccacgcgtccggtgctctgtgctcagcctcgacttccaccctctctcccgtcgcctcactgcagccggcgtggaccacgacgtcaagatcttggaggtattgtcggatggctcggacggcaagtgtttgtgaccttggtaactccgttttcattaaccacacacctctagcaaggagtacaacctgaaaccaattggtgatgctggtcctgtaactgaggcgggagggatctttgcctatgcccggaagacatgaatgattgcgttgaaagctgctgcatgagggaaaggtaaaataattgtatttcatgttaagttcctatgcatatcaagctataaaattgagccttgtcgatacatattgttgtgtgcttagattagtcttcatataattgttgttcagggataaaatgggttcatattagtcacttgtgtttgatagtttcatgtat

SEQ ID NO: 81428 - DNA, 335 bp, Zea mays
  Clone ID: LIB3088-050-Q1-K1-H3
cccacgcgtccgacttgaccggcggaagttctgcctaaatttgttgtcgaacggatgaacgagtatattgtcggtgctatgccagcaacagagcttattttgtcccgaaaaaaaaaaacagaaagagaaagagaccattgaaaactacgaaatcattaaccacacacctataagcaaggagtacaagatgaaaccaattggtgatactggtcctgtaacttgagcaaaagggataaaaagactatgccccatttacatgaatccaatgttttgaaagctgctttatgaaggaaaggtaaaataatgggaccccaagataaattactatgcatatc

SEQ ID NO: 81429 - DNA, 457 bp, Zea mays
  unsure at all n locations
  Clone ID: LIB3088-050-Q1-K1-H4
gttttagcttgtgatggaatttgggattgcatgtcaagtcaagaagtagttgattttgtacataaacagctaaagacggaggataagatatctagtgtgtgtgagaagttgctcaaccgctgtgtggcacctacatctggtggcgaaggatgtgataacatgacggttattgtggttcaattcaagaaaccagctttagctgttgctacttctagcgctgagcagtctgctaccactgcagaagggatgcggcccaacgaggtcgatggcccagattaccccccgaagtaggcgttgagtggcacaccgtgctgtggagctctaaccggtggataatagacaaaaaaggatagtgaggtggtgtatataagaaaagggattctattcgacaatctcttatagggtttgntgcttccttctttctagtgttcagagtcgtcgcaacctgtaatacatg

SEQ ID NO: 81430 - DNA, 443 bp, Zea mays
  Clone ID: LIB3088-050-Q1-K1-H5
cccacgcgtccgcttcgtgaagacattgactggcaagaccatcaccttggaggttgagagctccgacaccattgataatgtgaaggccaagatccaggacaaggagggtatccccccggaccagcagcggctgatcttcgccggcaagcagctggaggatggtcgcaccttggctgactacaacatccagaaggagagcaccctccatctggtgctccgcctgaggggcggtatgcagatctttgtgaagaccttgactggcaagaccataaccctggaggttgagagctctgacaccatcgacaacgtgaaggctaagatccaggacaaggaggggattcccccagaccagcaacgtctgatctttcgccggcagcagctggaggatggtcgcacccttgcagactacaatatccagaaggagagcacccttcacctggtgc

SEQ ID NO: 81431 - DNA, 229 bp, Zea mays
  Clone ID: LIB3088-050-Q1-K1-H6
ttgattagccgtttgcttcgctcagtagccttgctctccagtgtattatcactcgcatgcatgtgatgtgagccactgcacgcgtgagtgtcacatgggtcgtcgtcctgtctcgtctcatgtgtttcaaactgtaggcagcagaggatcgagatgcgtgtctgctttgttcgtgttcactgctgtcagtctgtcaccgagttcaataatttagctttgtttcatcggg

SEQ ID NO: 81432 - DNA, 274 bp, Zea mays
  Clone ID: LIB3088-050-Q1-K1-H7
cccacgcttgacgcacacgcgtgcgaattgaccggtggaagttctgactaaatttgctgtcaaacggatgaactatatattgacgttattataccaacagcacaccttattttgtcccgaaaaaaaaaaattactagactaatgtgtaactaactgtaagcaacagagtatccaaataacgtgtatcgatttattcgtgaacaatgctatcaagactgaaaccgaatttaaaaattaaaacttagataaataaaaagtgtgcaccttttataag

SEQ ID NO: 81433 - DNA, 350 bp, Zea mays
  Clone ID: LIB3088-050-Q1-K1-H8
ccgcaagtaccagaagagcacggagctgctcatccgcaagttgcccttccagcgcctcgggcgtgagatcgcgcaggacttcaagaccgatctccgcttccagtcctccgtcgtcgccgcgctgcatgaggccgccgaggcctacctcgtggggctctttgaggacactaacctctgcgccatccacgccaagcgcgtcaccatcatgcccaaggacatgcagctcgcgcgccgcatcaggggagagagggcctgagcgaggcgagctcctctcaccgcaggcggcgtcgttgttgcttcgggcctgcttgtatgacttgtgcttctcttggtttccttctggtggcagt

SEQ ID NO: 81434 - DNA, 411 bp, Zea mays
  Clone ID: LIB3088-050-Q1-K1-H9
aaaaaggcaaatggatcagaaaaaatctcaagtcttgtatttaagattactaatagggttgcgatacaaaacggtcctcaaagctcacagtgctgttgtgttaaaggctgagagcatggccgacaaggttgagtgggtaaataagatcaaagctgttattcagagcaaagggggttctttcaagggtccaagtactgagggtagttcaatgaggcaaagcaattcggatggcgctttagatactatggcacgtagacctgctgatcctgaagaagaacttagatggatgtctcaggaagtcgtggttatgtcgaagcttgtttgaatagtctggcagcaaatgttccaaaagctattgtgctttgtcaagtggagaaagcaaaagaagacatgcttaaccagctatacagc

SEQ ID NO: 81435 - DNA, 344 bp, Zea mays
  Clone ID: LIB3088-057-Q1-K1-B11
gcataccgcatattttaagcatcccatgaatgctcaaaaacttcgtatgctgcaattgatggatcttacattccgggttggcaaggtatgctcatccgtatttgaagattgacgttgtttataacctgatactattatttgataagatacatatagtcttgtcagttggctttacctttcgaaacattttgattgttattgtatttaataataacatattttcgtctttcctgtaaatacctgttaaagttaacccttatttctgttacagttttaaaataaattatttatcttattataattattattttatttctttcttatattattttttatttttttta

SEQ ID NO: 81436 - DNA, 228 bp, Zea mays
  Clone ID: LIB3088-057-Q1-K1-E11
cttccgtcgtggtcttagcaatttcggttggcaatatttcctcggcttttcctttggctgctacgaggcttccaaatcattctgggaagccctctccacttccaaaaccaacttctccattctctgcatagagactaaaagatttctcttgtggtattcaaagtaataaatcaaaccatttccaaagatcttaaagccctaacttgtgaaattttcttaccgaccgtt

SEQ ID NO: 81437 - DNA, 300 bp, Zea mays
  Clone ID: LIB3088-057-Q1-K1-F10
ttctgctttgatgttcttcaattaaagtacacttattttgagcattattttcatgatgctttattttacccaatccctgaaacttttggcatcacatgacttgatgtaaaccatctttagaagaacatttgagatactacagcttctattttcaaaagtttgaatctgtctacacacattgtgaatattacagtggtgatgatttataagatgtaaatattctaaatgggctggtttcactgacacacgatcatatggccctggtttggtgctatgggttcttcttttgagttgaatccc

SEQ ID NO: 81438 - DNA, 389 bp, Zea mays
  Clone ID: LIB3088-057-Q1-K1-H11
ccggtcggacgcacgcgtcctaaagaggcatatggatcataaaaaatctcaatgtcttgtatttaagattactaatagggttgcagtacaaaacggtcctggaagctcacagtgctgttgtgttaaaggctgagagcatggccgacaaggttgagtgggtaaataagatcaaagctgttattcagagcaaagggggttctttcaagggtccaagtactgagggtagttcaatgaggcaaagcaattcggatggcgcttttatatactatggcacgtaaacctgctgatcctgaagaaaaacttatatggatgtctcaagaagttcgttgttatgtctaagctgttttgaatagtcttggcagcaaatgttccaaatgcttattgtgctt

SEQ ID NO: 81439 - DNA, 448 bp, Zea mays
  Clone ID: LIB3088-050-Q1-K1-G6
cggacgcgtgggtcccgcgacacgtactgctggcgatccgcaacgatgaggagctcgggaagctactggccggcgtcaccatcgcacacggcggggttctgcccaacatcaaccctgtgctgctccccaagaaaaccgctgtcgctgctgccaaggaaggcaaagagaagaagtcacccaagaaggccgccgccgccaagtcgcccaaaaaggtggccgcctcgtaggtccctggcaatgctgatgcactgtctctctctgtcctctctgaactgaaacgctcctaactgtcgttgtcggtcatggtcgttgttgtttgatgcgcttttattgtggttgttcgtgtgtaattgcttgcctttcgcccatttggcatgcactgtgtagggtcacactggtctaggttttcaatctgggaaacaccggtttagattcaaggagcgtgaac

SEQ ID NO: 81440 - DNA, 402 bp, Zea mays
  Clone ID: LIB3088-007-Q1-K1-C10
caggactctcttcaagcttctcatctcgctcaaggggggtcatctgatatcagggagaggttgttgaaggccgttgctgcgctagccggatctaatgtcaatggcaccttatgcttttcacacgaagggtatagtgctaccaccgttactggaagaatcttttgcctcaagtgatgcttgcatgggttccatgtgcacgcgcttggcaacacctgcaacggctgcatagcaactgggccactcttcaatcctgctggcgatgatcattgtacactttaagatcttgaccgacatgccggataccactggaactggacagctttagaagaaacgcttgaatatgacgatatgactgtcaacttgatctcacatgctagaccctactagataattggccgagct

SEQ ID NO: 81441 - DNA, 390 bp, Zea mays
  Clone ID: LIB3088-007-Q1-K1-C11
gtggtactggcaacttccgtgaaaggggacttggggtgtcttcgcggaggccacttggtgttaatacttggtcctcatcatttgctattgccaagtcattcaataaagcaaaggattttgtgtggagacatgatctctttgaggatagcatggtagcagctgggctttctgggatagaatctggaacaaagctttacatttcaaatttgcactatggagtgacaagtgaagatctacaggagcttttttcagaaatgggtcatttgaagcactgtgctgttcattatgacagttatagacacccaactggttcggctgaggtgatattcaccaggagaagtgaagctctcgcagcactgaagcgatataataatatgcgccttgatggga

SEQ ID NO: 81442 - DNA, 382 bp, Zea mays
  Clone ID: LIB3088-007-Q1-K1-C12
atcctcaggggcaccaagcactctccggcttctcccacctgggaccacgcgagcgacgcggtcgacgccgacgccatcgacgacgcgtcctcagatgccagcgccagcgacgcggagctgtgctgcatctgcttcgaccaggcgtgcacgatggaggtgcatgactgctggcaccagatgtgcgcgccgtgcacgcttgcgctgagcttgcacagtaagcccgacccggtgactctagcggttccgttgtcagacttgcgcgattggcagggcagcatcttgcagctggtcctggttggccgggcaagcagctacgacgcggacaccgtgaagtcggcaggtgcagcagctgctgccttctacccgcagcttgttcggcggc

SEQ ID NO: 81443 - DNA, 460 bp, Zea mays
  unsure at all n locations
  Clone ID: LIB3088-007-Q1-K1-C2
cagcgaggcccgaccacgccgcgctgcctccgagcagcctgctgtccctgcagctgccgcggtgctcggcgggaattggccgcacggcgccgagcctggccctggcgccgccgaaacagaaccacccttcttcgccgctgacggcggcaaaggctggtggcctggcgccggacctggagctgaagatctcgaccgcccggcagagcgagcaccagcagcaggtccagatggggccatcgctgccgccgccgccgccgccgccgcagaggacgccctttctggggaccatcagggtcacatgacatgaccggcaaagacggcggcggttagtagggaatatcctgctggtaggagaagagcttttgcccatctgaagctggagaagggttgctcaaaagataggacggngtgggaaaactgaaaagaggaagctttggcagcgtgtgcntgcgtgtgtgtg

SEQ ID NO: 81444 - DNA, 421 bp, Zea mays
  Clone ID: LIB3088-007-Q1-K1-C3
cacaatcctatggctaacccgaggccaatcagaatgcctggaaatctctttcagtggtggaactaacaaatagttgctcccgagaatccatgattttaaccattatgaactccataagagatttaccagacttggagttagagaatataaggagtcaactgctgcgtgatttctcccctgatgacgtgtgcccaagtagcgctcactttcttgaatcacctggcaagattgcaccgtcatgttctgatgatgacaccgactacgactatcaagaggctgaacttatcgatctgagaaatgacaacaatacttatttggaagcctctgcaactacactggcggctatagctattcctgtgcccacaacaaatcttctcagtatcgatgaacttctagaaacagtcgtgaatgatgtgtcatc

SEQ ID NO: 81445 - DNA, 453 bp, Zea mays
  Clone ID: LIB3088-007-Q1-K1-C4
actcgtacatatcctcctctgctgtccccctctggcgtttgcggggccggtgctttctggtccttgcggccgcggcaatggcgtcggggaacaacaacaaccagaggagcgaggaggagtggcgcgtcgtactctcccctgagcagttccgcatcctccgcctcaagggcaccgagttacccgggacaggagagtacaacaaattctacggcgacggggtttataactgcgctggctgcgggactcccctgtacaagtccgccacaaaatttgattctggctgcagctggcctgcattctttgaggggcttccaggagccataaaccgaacaccagatcctgatggtaggagggtagagatcacatgtgcagcctgcggtggccatctgggccatgtgttcaagggtgaaagcttcaagacacctactgatgagcgccactgcgtgaatagcg

SEQ ID NO: 81446 - DNA, 402 bp, Zea mays
  Clone ID: LIB3088-007-Q1-K1-C5
cggacgcgtgggcggacgcgtgggcggactcgtgggcggacgcgtggggtgcataaaagagtaggtaccacaatgagattgtgatgctgcacatggcacatcaaggtgcacaagatatgtaccgtagaaattatcgtaaagtgcacacagctgtatgtatagatgtttagaagtggccgaagttaggcttgctcaaccggggcaatgatttacttagcctgctgaaatgtactataggtagcattcaagtttgtgaccatcatgcaagtacatgtgggtttgttgaaattgagtggtcatcggagatgtagcaaaatgttccctatcgagagctcgtgtactatatttgttttatgaacttaatttttattacaacaaataaaaaattaattcaaaaaataa

SEQ ID NO: 81447 - DNA, 239 bp, Zea mays
  Clone ID: LIB3088-007-Q1-K1-C6
aagaaaaccgctgttagataagaaatacactgctgtgtattagtagttaatgacaagagttcttggtttttgtatgtaaccatattgtggatcggatccattgttcttccccatggacactactactaccagtctaccagatcgatgttgaccttgtggcagttgctgcagttttttttttttgacagagaaatctgtaccttatgctgtgtgtgtttagaataagaaaatttttctcc

SEQ ID NO: 81448 - DNA, 299 bp, Zea mays
  Clone ID: LIB3088-007-Q1-K1-C7
aaaaaaaaaaataaaaaataaaaaaaaaattaaaaaaaaaaaaaaaaaaaataacaaaaagaaaaaaaataaaaaatataaccatataaaaaaataaaatccataaaaaataaaacataaacactactactaacctatctaccaaatcaatatatatccttatatcaattgctgcaattttttttttttgacatacatatctgtaccttatgcatgtgtgttatttcagaatatagataaattttttcttccattatatcaaaaatcgtaaactatcttttatatggcatccgttttaa

SEQ ID NO: 81449 - DNA, 386 bp, Zea mays
  Clone ID: LIB3088-007-Q1-K1-D1
cgctgttttgcctcttccccctacccgtttcctcccttcgtgctggttgtggttctaaggtcctgattgccggccgtcccgccttcttccttgccaagacgagactctcctcctcctgccactgctaccgctgctcctctcaactggtgaactggatcctgatttggggagaaggttaaactggatgcctatgtaattaattgcatctctttaccattctacgtactactagtattgaagtaaaaaaaaaaaaacaaaataaaataaaaaaaaatataaataaaaaaaaaaaaaaataaaaaaaaaataaaaaaaaaaaaaataataaaatcataaataatttattattataaaaaaaaaaataaaaaaaggggcggcccctttaa

SEQ ID NO: 81450 - DNA, 425 bp, Zea mays
  Clone ID: LIB3088-007-Q1-K1-D10
cgctgctcccacctctagcccgacaggtgaagccgccgccgctgcagtgtccatagccagccgcaggagactgagatggggggttttgtcaagacccacaagagcaatgcgtacttcaagcgtttccaggtgaagttcaagagaaggcgcgctggcaagacagactacagggccaggataaggctgattaaccaagacaaaaacaagtacaatacacccaaatacagatttgttgtgcgatttaccaacaaggacatcacagcacaaatcatctctgctagtatagcaagtgatatgggtcttgcttctggttactcgcatgagttgccacgatatggtcttgaagttggtctgaccaactatgcagctgcctactgcactggccttctgttggctcgccgtgtgctcaagacccgtggtttaga

SEQ ID NO: 81451 - DNA, 377 bp, Zea mays
  Clone ID: LIB3088-007-Q1-K1-D11
cactcctggcacatatgtcgacgcaggtgtaggcggcgtcgctggagtctgcatggtcaggggagtagactgggaggaccagaagagtgaagaccgacatgacctatgcatgcttgatgcgaatggaaacgtaaatcagcacaccgtctactgaagggatagactacatgtatcctgatcaggaatgatgcaccaatacgctgacccatgcaggccaatcgaattcagatcaaccatgcgatctactatcacggacatcacaaggcatatcatctctgctagtatatcaagtgatatcactaccggttgtgcatacatagctgaatagccacgatatgctattgaagatgctgttaccaactatgacgaatggtact

SEQ ID NO: 81452 - DNA, 394 bp, Zea mays
  Clone ID: LIB3088-007-Q1-K1-D2
cggacgcgtgggcggacgcgtgggcggactcgtgggctgacgcgtgggttgcgcttgcataaatgtggccgtaatgttacatgccctgaacttgtagggaggtgttcaattgtgcgtgagcttcatgtctatggaactgcagtccctgtgcatggccgcgatgtggacaaactgcatcaccagggatactgaactctattaatggaagaagcacaaaggattgctcgaaaggagcaccgatcgaagaaattagctgtcatttcgggggttggtactcgccactactaccgcaagttgggttatgagctagaaaggccctacatggttaaatgtttggcgtaatgctatttcattttccgtatcatatagagcatacttttgtttgtaatgtata

SEQ ID NO: 81453 - DNA, 109 bp, Zea mays
  Clone ID: LIB3088-007-Q1-K1-D4
atttgttcaaatgttacccagaacgaccatcagcgaacacatccgcttgttttattcaagtgttacggagaacgaccaacagcgaacacaagacaagcggatttgttgc

SEQ ID NO: 81454 - DNA, 405 bp, Zea mays
  Clone ID: LIB3088-001-Q1-K1-A2
tatacgcgtgcgtatgtagatcagacggctctactatacaggctatgttggtcgctgtgtggtgcactgaaaggtgtgatacaatggggaaaccatgctctgtacaactcagtgcacgacgcagttctggccattgtagattttatcaagagggtggggcccataggctgggactacctatggagctagatacagcacttgttatatcatttgtaactagattgggctctagctcttgtgtgtcttctccaattgtgacatctagcgtgagcattatcattgggacatttttcaatagagatatgctatgtgtcttatcaccccctgtatcagacatgcatcccgttcttattctagtatggagtatcacatatggtaaaagccgtaggaatcttgatagaaatt

SEQ ID NO: 81455 - DNA, 379 bp, Zea mays
  Clone ID: LIB3088-001-Q1-K1-F3
cattgtaatgttcatccctgggttctactacacaaggatcgcctactatgcttacaaaggttacaagggcttctctttttcgaacatcccaccgatctgaaggagtgtgctgctgcctgctggttatgaagtggtgtcgctggtttaagagtttgtcgactctgtcgaatggctctgtagacacccttgttctacatctgtctgtggccattctctttgaacactctagaatgaactggtggatgtgtacagataaatgcagccatagttgtgctcctccatcgcggtttggccgattggaaggttgcttgttgtgctcgtgtgaccatgttcaactaatacgcatcgctacttgtgcattaaaaaataattattatat

SEQ ID NO: 81456 - DNA, 246 bp, Zea mays
  Clone ID: LIB3088-002-Q1-K1-A11
gaaggcgaggactggatgtaccttgatgtaagatgcacattgaactgtatcttgtgggatagatgagctatataactagctcacgcagctgactgtatgatctgtagttcccccgttatctgaattgttcatgtattacgccatgtactgctcagcagacctatgtagctagttgcacttgtatgacttcagcatttctgttgccagttgtttgtttcgtctaaaaaaagctaaaaaccaaggaag

SEQ ID NO: 81457 - DNA, 138 bp, Zea mays
  Clone ID: LIB3088-002-Q1-K1-E8
ggcataaaacaaatgtattggtctactacaggtaccccaaatattttctggtcctttcagcaccaacaagagccatacgcatatctagaagacaaaatgccgggcggacgatcaaccctgtgaacggcgccctggggc

SEQ ID NO: 81458 - DNA, 356 bp, Zea mays
  Clone ID: LIB3088-002-Q1-K1-F3
cccacgcgtccgaagcagccagcctctttcactggttctgaggttcgaatcattgatgatgacatgcccctcgctcaatttgctgttgctttcaatggagcatcatgggtggatcctgattctgttgcactgatggttatgcaaacaatgcttggttcatggaacaagagtgctggtggaggaaagcacatgggttcagagcttgtgcagagggcagcaatcaatgacatcgctgagagtgtaatgggattcaatacgaattacaaggacactggtctttttggtgtctatgctgttgctaaggctgattgcttggatgatttggcttttgcaattatgcatgagatgagcaaatt

SEQ ID NO: 81459 - DNA, 344 bp, Zea mays
  unsure at all n locations
  Clone ID: LIB3088-002-Q1-K1-G1
gacagctggtacaagacggtcattttagctggtggttcgtcgtgcttgcctggtttaccagagaggctggagaaagagcttcaccaacttcttccaccttatatgtcagaaggaataagagtactccccccttcatttggcactgattctgcctggtttggtgcaaagatgatcagcaacgtgagtactttcactgaggcatggtgtgcaaagaagaaacaattccgtcagaagacaggccggagtggtacattgtttgccaattcctggtaatgaaaatctcagacacaagtcacgagcaagaaacttaaagagttccccgcatcanaaatacggacataaca

SEQ ID NO: 81460 - DNA, 290 bp, Zea mays
  Clone ID: LIB3088-002-Q1-K1-G11
tgttccgcttgcccatgcctgctccctttgtaggccgttttgagaacatttctgtgataactcttcctgctaatactttcctgaagatgtgttactatatatttgtactgttgcttaacattctctatgtggagaactgctagctgcttgtgtcgagcagttttagtttaggaaacactatgaggtctggtaaacagttgagtttgcattttgaataagtagatggccagatatctgcctgggaaaaaaaatcatacatctgattgggactcaacactgtataacagcat

SEQ ID NO: 81461 - DNA, 339 bp, Zea mays
  Clone ID: LIB3088-003-Q1-K1-B3
cccacgcgtccgcccactcgtccgcggacgcgtggggcgtggagcaccgggtgccagccagcaggagcagcgacacggcgagggtctccgtggcgtccttcttcaacacggacgtgaggaggtccgagaggatgtacggccccattccagaccccagcaagcccccgctgtacaggagcgtcagggcccgagacttcatcgcaaagttcaacaccataggactcgatggccgcgcgctcgaccacttcaggctctagctgcctggctggctacgtttcagattcgtcctttcatttgctttggtctctaattaataattccaaataataagcccgcgga

SEQ ID NO: 81462 - DNA, 241 bp, Zea mays
  Clone ID: LIB3088-004-Q1-K1-C7
taaatgcacatacatatctactgatcacactttcttcgcaaacgccccactcattgcatatggtctataccaagtagccacacagctacaaaactattaattaactcatactactgctataaatactattgaataacgaagaataaacctacctatacgtaatatcacaatactctacacttaccttaaattgtaccaatctctgtaaatcattactatcaactgaagcactttaataact

SEQ ID NO: 81463 - DNA, 229 bp, Zea mays
  Clone ID: LIB3088-004-Q1-K1-D2
aagccttgattctcccccattacaaatgggtataatcttcccatgccattgcataatatatgatccattgcaaacgtaatgcagcattacaagatcacaacagatggcctatgttcatttaccccgagttccgtcaaggacaatgaaaagcgcacctttttaaccaaaaaacttagaatatcgacggagatttttctacacaacagcactggcaatacataaaccagac

SEQ ID NO: 81464 - DNA, 465 bp, Zea mays
  unsure at all n locations
  Clone ID: LIB3088-004-Q1-K1-H5
tatgtatatatatatagttgtagcaagacagagaaagacacaacttatgatggagcaagtggaagagctccgcagaaaggagcgacacttgggagaaatgaacaggcaactcaaacacaagcttgaagctgaaggttgtagcaactacagaaccctgcagcatgcagcctggccagctcccggcagcaccatggtggagcatgacggcgccacctatcatgtgcatccaactgctcaatcggttgcaatggactgtgaacccactctgcaaatcgggtaccctcctcatcaccagtttctgccttccgaggcaagcaataatatcccaaggagcccccctggaggcgagaacaacttcatgctgggatgggttctttgagtttctctngtaatcatccatccatcagaatgatgtccaaacaataaaggcactcaatgctaccatatgcatatncattgctaaat

SEQ ID NO: 81465 - DNA, 70 bp, Zea mays
  Clone ID: LIB3088-005-Q1-K1-F7
aaatcttacataatgcttattggtggtcggtaaacccataaggcaagaaaggcatacaagcttttaaaga

SEQ ID NO: 81466 - DNA, 208 bp, Zea mays
  Clone ID: LIB3088-005-Q1-K1-H7
taaatttacaggtgacaagcaacggtggtgatgcaaggctggccgagaaatttgatcaagactgcatgcatctcgatgtgcccttgtatgtaaataaataaattgtcatgggttttattttatcgtcgtgatagcagtgaattttaactaacagctcaaggcaggctagcagaatagaaaaatataatatggatgcatgtcttgtttc

SEQ ID NO: 81467 - DNA, 139 bp, Zea mays
  Clone ID: LIB3088-006-Q1-K1-G8
tagttctagctttagctgtacttttgtttaggtcatcatttgattttcaggtgaacaatccgattgggcatcttaaacatccctatttgtaggatgaaactcagaactggtggctaccaataaagtgctgttttttttc

SEQ ID NO: 81468 - DNA, 261 bp, Zea mays
  Clone ID: LIB3088-007-Q1-K1-C8
tccggttttatctggatgtcatgtatggtcgacggtcgttgctggcttggcgttccgaaggcagcaggcatactggtgctggaagacggtacctgctgtcgcacttgccgttataataggcattggaacttgtcgatttcgggagctgatctgtttgtaccgtattgtttatttataatatgatggatcgtatgttgataaaaaaaaaagaaaaaaaaaaaaaaaaaaaaaaaaaactacaaaaaacaaaaacaacacaaa

SEQ ID NO: 81469 - DNA, 382 bp, Zea mays
  Clone ID: LIB3088-007-Q1-K1-C9
cggacgcgtgggcgcgggtctcctcgtagatgagccccgagatgcgcttcacgccgccgcttctcgccagccgtaagaccgtcaccgccatggacgtcgtctacgcgctcaagcggcagggccgcaccctctacggatttggcggctgaggggtcaggggtgtccgccagctgctgctggtcgtggcagaagtcttgggtcgcggtcacgaaatggagtgattcgagagtattcttgcccatgggcttagtttcgtaggcttatcactctagactctagtgccttggtccagtagtagcatacgacttgtactgcatttctttgttctgaacctctaaatatgatgaaatgtggattcactggatctcacagacaaccagtt

SEQ ID NO: 81470 - DNA, 329 bp, Zea mays
  Clone ID: LIB3088-007-Q1-K1-D12
cggacgcgtgggctcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcattctggatttgcttgagaatgctgagagtaacgctgatgtgaaaggcttggatg

SEQ ID NO: 81471 - DNA, 293 bp, Zea mays
  Clone ID: LIB3088-007-Q1-K1-H5
cacgggcgtaccgtcgacaatatctactctcactagccacgccctatcctgggcataaaggataccgattggtgctatcatggagtcgagacttacccagacgctgcacgcgaaacctgctgacgactgcatcaccttccatcagaccctcctacactaatacattgcaattcctaaatcctaaggactggtaccaacatctcattacattctacaattgactctatgctagttagcgatttaagatcttacgatctctagaaaacagtttagaatcttacataccaacgacc

SEQ ID NO: 81472 - DNA, 331 bp, Zea mays
  Clone ID: LIB3088-008-Q1-K1-A7
gacgcctgactccaaaccctttcgcctccgccgccgcctgatagctccagcgccctcgccgtcggctgcccggctgccgtcctcccgctacgagctaggcatctccttcgccgatccaacatgggtaagacacgtggtatgggagctgggcgcaagctcaagacccacaggaggaaccagaggtgggctgacaaagcctacaagaagagccatcttggcaacgagtggaagaaacccttcgctggatcatcccacgcaaagggaatcgtcctggaaaagattggcatcgaggccaagcagcctaactctgctatccgtaagtgtgctcgtg

SEQ ID NO: 81473 - DNA, 417 bp, Zea mays
  unsure at all n locations
  Clone ID: LIB3088-008-Q1-K1-D8
cctgctcgtccacgaggtgaggaaaccctatcgaccgaccatggcgttgctcccgcgcgccgcgcggctggccctcctttccaccccgcgggcgtactccgctgccgctgctgcgggcgcctccccgacgtccccagcgccatacgggggcgcccccccaccggcgatgtcgaagacggccgagttcgtggtctctaaggtggacgacctgatgaactgggcgcgtaagggctcgatctggcccatgaccttcgggctcgcctgctgcgcggtggagatgatgcacgccggcgcgtcccgctacgacttcgaccggttcggcgtcatcttccgtccgtcgccgcgccagtccgattgcatgatcgtcgccggcacgctcaccaacaagatggctcccgccctncgcaaggtttatga

SEQ ID NO: 81474 - DNA, 292 bp, Zea mays
  Clone ID: LIB3088-010-Q1-K1-D9
tagaaataaaaaaaatcgaggtgtatacaatttaggaggcatttaactggtatttgaaagttagattgtgctgcaatttaccattcttgtaatttagtattaaaaggctattcctgttttctcctgaaattcggaatgccgcaccatgtttctatccaagtaactcctttatgcatgtcttcatttgggtttggcagactcaagtgttacttgatgaactttgtgacttaaagagaaaggaacaaatgctgcaagatgcaaacagggttctgaaaaagaagcttggctagtt

SEQ ID NO: 81475 - DNA, 315 bp, Zea mays
  Clone ID: LIB3088-011-Q1-K1-C7
catgtttgtgttaaatgccttttctatccaaatagaacacacaatggacacatgtaagcagatatgtactccaatctttagattttcgttgttaaaacactctatttgtttaatgatgttattgtcaattaaactaggatcagtggtcttctctataaaggtatatgttgataaaaaaaataaaacaaaagataaaacaaaaaattaaaaaaggaaggccggtctaaatagtccatcctagcttaccttcgcgtgcatgttaaggcctagctcttctgtagagttaagttaatttaattgactggccttttatat

SEQ ID NO: 81476 - DNA, 441 bp, Zea mays
  Clone ID: LIB3088-013-Q1-K1-G8
cccacgcgtccgtgactggattaggcattacctaccgggttaacgggatgcatgatataccttgctgtgcaattattacggcgtaacctgcgtcgctgctctcctgatcggagatcgaccaccttgactcattggaacatagccatatatctggcagctagcatatatctgatcaaagcaaagccatatatctggcagttctggggtgatccgtccgtggaaaaggcttggccactgacctgcgcgaggacaaagcagtagaaacatatcagccaatcaaagcaaagccatatgaattcatgttaaacatgtccatacatatagcagtgaaaagtatcaaatcactgatttcttctcttggcctttgtaactgtacatactgctttcgaggcctttgtaattgttcatacttcttacgggcattcattatgcaagcatgct

SEQ ID NO: 81477 - DNA, 179 bp, Zea mays
  Clone ID: LIB3088-014-Q1-K1-H6
tataattactgtcctttattcctgatgtttgttttgtagttgaaactcacattgttttgtcatttccatctcgattttgtatgccgtgaccacgaaagattaaatgttttcttgcggtttctaaaaaaagaagagcccgctgacgaaaaagccccaacaaggacgaacgctatagacga

SEQ ID NO: 81478 - DNA, 432 bp, Zea mays
  Clone ID: LIB3088-014-Q1-K1-H7
tatgcactcggtccagcaggtcttacgaatgctaatgagagtaaatccacagggcatggccatgatgatgatctgtgtctcatggatcccgacggcaaaaatatggaacctgagccacccttccgctcgctttatagccccgtcgccatggcgtcctggctgacatcctcgatgccaagcccatgcctgcgtcgaacgagagggagaccatagacacccactggccctggcggtagtagagccaaagatctattcactagaagtacgcgacgcgccatggatcgcgtgcagccgacgatacctccgctgccatctgtccacaaacagacgactctggcggctaattgtagcacttccagagcggagacgcgttcaatgctccggttagatggtactttcgacattgaaacttgctagcaacttttacggatg

SEQ ID NO: 81479 - DNA, 275 bp, Zea mays
  Clone ID: LIB3088-020-Q1-K1-A9
gtgggggggggggggccatgcaagcggaaaactccgtttggacccttttcacattttaaaacttgtggaaaaaaaaattgcatgtaaataactgggttgttgcggatcttaaagatccagtgggatttatgcaattttggcttgaaaatttgcttctgtttggcaattttcatgtaacataatttaattcacccggacaacagactccccttttcttattttgggaaatattaagcatgtaccttcaaaaaaaaaaaaaaaaaaagggccgcccc

SEQ ID NO: 81480 - DNA, 458 bp, Zea mays
  unsure at all n locations
  Clone ID: LIB3088-020-Q1-K1-C6
ggaattcccggtggacgacgcgtccgctaaatacctgcctggatattctgcttcatgatagagtaagctcaattcctataggtggggacaattgatccggccgtgatgtctactcactcantgatatcatggctctggcgaagaatgatgtttatgctcgcatcgaacttgaacaagtgaccgtacaaaatgctttggatgtgcaataccaggtgcatggccgaagacagtgtcatacttgtttacagacgagtaccttgctggaagttttggagggattgtccattccaggagtgcgacggcttgttgttattgaacaaagtaccagatttgtggaaggaatcatctcattgagagacgtatttacatttctccttggatagcatgtgtatccattccatacatgaaaaagcttgctgtacttggttcaaacgaaataaaatgcttacaaatgtgat

SEQ ID NO: 81481 - DNA, 422 bp, Zea mays
  Clone ID: LIB3088-029-Q1-K1-A5
aagcttatggcggttgaatcccttgtcttcgcccccttcttcgccgcccatggtggcatgctcttcaaatggctctaagccagcgagagacgcaggataaaggccgtagttttgcaaggcgagtagagcagtatgtcagtaatacagcatctatggcatgtgcttttgctcgtccagttcatgagccccgttgtgtatttggtttccgttttcttggttggagtttttagttccaaggtccgatcatgttttgatcccataaattctcttccagccttcgagcaactgagtccatcttcctaagtcatcagtcctagcgagacattgaatcatggggaaactttaacagtattggtgatgatttaatctatcttttttgttcttggagtaattcaatatggactttgcttaaaataaatatt

SEQ ID NO: 81482 - DNA, 380 bp, Zea mays
  Clone ID: LIB3088-029-Q1-K1-H1
aacggatagcgctcctcgttggcgccactggcgggtggttctgcctctggtctggtgtgtgtgtgtgtggtcacacttgccagctagcagaggcgcctgcttgtacctagattactgttaccattgtcgtcgtcatcggctaacattgtcataatgtcagtttgggtcatgttagattaagtcaaaaaaccaagtcaataatgaagatacaatctgtatgagatattttattcggttcaaaccattctctatatttaattgctagtatgatgtgatttcgtgttttctaactctactctctttattgttttgctttttattagtattaaaggggggtcttttttaagggaacaactttttgtgtggcgctttttttatgt

SEQ ID NO: 81483 - DNA, 121 bp, Zea mays
  Clone ID: LIB3088-029-Q1-K1-H10
tacattccatccaatatctacatatatattagacataatcagaaatattcagggattaaggaattctacaaggtgatgttgggtatgaacaactttatcaacaacatctacatgaaacaca

SEQ ID NO: 81484 - DNA, 375 bp, Zea mays
  Clone ID: LIB3088-031-Q1-K1-F11
ggctcccgtgacgattctgtggcacactgtagcggtgtccatggcagtccggtgtgctgtgctcgcatgttcgaccgtgccacctctagcatgtacaccgtgcgcgtcttcagaactcccccgttacttgtatccggtgcatgccaccgttctggactgatatcttgtaggttccacttaggaatcagtatcagcgactctatcctagatggtttgtagctcgcacggcactcgttcttgcgtcgcatcgaaaccttcaggctaaatgcttagttgaaactgttcccgtgattcttaagctatctatgtatctgaggattccccggcatgctttcgacgatgaacttgaataatttgaatgcacgatgattgttt

SEQ ID NO: 81485 - DNA, 295 bp, Zea mays
  Clone ID: LIB3088-032-Q1-K1-D12
ttaaggactacaaggagaagcaccccaatgggaagcaagtctccctgattggcaaggctggtggtgacaagtggaagtccctgtctgatgccgagaaggctccctacgtgtctaaggcagagaagctcaaggctgagtacaccaagaagatcgacgcttacaacaacaagcagtctggagaccccacggcgtctggtgattccgacaagtccaagttcgaggtgaacgacgaggacgaggagggtgacgagtgatgtatgacggatgaaactctgtccagtgtttgcagtcaggg

SEQ ID NO: 81486 - DNA, 373 bp, Zea mays
  Clone ID: LIB3088-033-Q1-K1-E1
tacagatggtggaaataacaaaagtacatgtacagcctgaagtagaaaatgttactaatatccatgaaagagctgcttcaatggaagaaaagcagtccgtgccagagataggagatttggtgggaggtggagaaaaggtagttagtaaagaggttaagccagcaaaagatgaggtgatcgacaaggacctattgcaggccttcaggtactttgacataaatggagcaggatatctcaaggttgatgatttaaaatgtattcttcacaacatggggaagtttttatcaagcatggacgtgaaggacttggttcaaattgctcttgctgagagcaattctgcaagggacaatcgcataatctatcctaagcttgt

SEQ ID NO: 81487 - DNA, 149 bp, Zea mays
  Clone ID: LIB3088-036-Q1-K1-D3
aaaagacataaaacaacaaaaaaaaaaaacctaattacaaaacaagacaaaaaacaaaaagaagcaagctttaaaagataaacgagcacagccctaaaaacacaaaaggccggaagccacagagctccccaccaaacaacctagcacct

SEQ ID NO: 81488 - DNA, 276 bp, Zea mays
  Clone ID: LIB3088-036-Q1-K1-F9
cggacccgtgcactcacacgaggagaagatccatgagacagacgcaacaccaggcaagggaccgagaaccccgaccaacagagggcgacgcgccggcacctcgaccgcagcgcgcgtaaccagcacaaaacagcacggctgactgtcgcaaggaacgtgcaagacacacactacgaccgggcaataagcatggaactattaagagtggcggccaaggagaacagaacgagctccgctgcccgatcatgccaacatgaacattaatgaatgtgcgag

SEQ ID NO: 81489 - DNA, 66 bp, Zea mays
  unsure at all n locations
  Clone ID: LIB3088-037-Q1-K1-A10
ccaacgcgtccgnaaaaannnnanntatggtaaagaaaaaaaaaaanaaaataaaagggaagggtt

SEQ ID NO: 81490 - DNA, 330 bp, Zea mays
  unsure at all n locations
  Clone ID: LIB3088-040-Q1-K1-B9
aatccccgggccgacccactcgggcggatgcgtatcattctcataagtttcaagctttacgccaaacgaccaccacctcagcncccgttcaaatttaaaaagcccctagcccctccaaaaaaaccaaaacaataaacaccactaaaacacaaaatcactctcaaacatcaacctctaaccccataacccctccaaaccaccactctcaccacctacaaaacctccacctctccacaaaccatcttctacaaacactcatacaaccaacctccattctcctttactcaccaaccaaaccaacaactaccacatcactctatccacacaaca

SEQ ID NO: 81491 - DNA, 101 bp, Zea mays
  unsure at all n locations
  Clone ID: LIB3088-043-Q1-K1-A3
cccacgcgtncgtgcagttaacgtgtgtggtgttctgctatggtttaaagtttaaccactgtgcatagtcagtcaatgttagcttccttgtccttgcnnaa

SEQ ID NO: 81492 - DNA, 399 bp, Zea mays
  Clone ID: LIB3088-043-Q1-K1-B12
cccgggccgacccacgcgtgcgctgtcatcaagttgataggtggacaaatttcaatgcccaagttgtttcccactggtgctggtttggcatctgtttgggaactttttacagcagtgccggttcttgtcactgcttacgtttgccattacaatgttcacccaattcataatgagctaaaggactctacccagattaagccaatagtacacacatcattgacactatgctcgaccatctacatcacaacaagtttctttggatatctcctctttggtgaatctacactctctgatgtgctctccaactttgattcaaatcttgggatcccatacagttcagtcctcaatgatgctgtcagagtgagctatgctgttcacctgatgcttgtgttccccatg

SEQ ID NO: 81493 - DNA, 339 bp, Zea mays
  unsure at all n locations
  Clone ID: LIB3088-043-Q1-K1-D5
taaagatgctttaattcctagtggaacaatcatataaagtcagccaacaccatgtatatagaggggggttgcatcatatggtgatcgccaatgtgcatcaagttctctcatcccttgcgagaccatgcttatttccattgcaaaatcatcaagctctgcatcaacttgttgtggataataatgaaataataaatggtgccattccatggcaacatttttctgtcagtagtttatgaggcactgttctaaatgtactgttgagtggaatttgaatatgtatgcttttgcaatcgcacacctaaataccttgtgcttatactccttgttacctaantnnaa

SEQ ID NO: 81494 - DNA, 406 bp, Zea mays
  Clone ID: LIB3088-044-Q1-K1-A11
ctacggcgaggtcctcgagtcgacgatcatcctggatcgggagacgcagaggtcccgcgggttcagcttcggcaccttctgcacggaggacgcgatgcgcagcgccatcgagggcatgaacggtaaggagctagacgggcggaacatgaccgctaacgaggcccagttccgcggctgccgtagaggcagcggcggcggatacagtggccggcgccgtgatggaggcggctacggcggcggcggtggacgctaccgcatgggtcgtggaggctacggccgcggtgggggatacggtggtgcaaaccgcggcggcggctacggctacaacgacgggaactggatgaactgagcggtggagtccgctgaggcctagttaatccggtcgcttatgctaccgcggtcaccc

SEQ ID NO: 81495 - DNA, 428 bp, Zea mays
  Clone ID: LIB3088-044-Q1-K1-D5
tagcgaagctcgagtctagggctgcccttgaaggtgaacttgctgaacttggcattccctcagagatatactgaactttctatgcttgtccatcagaacgtatgacaaacagaaaacctgaagtttctaagaaacagaagagaaagaacaagcagtcaacacagaccccgtcagtgaaaaatgagcctgggcaacaaatccccattacggaacttcaagttctacaagtcaatgtctctgcttaaaaagcaagaggcgtatgccgctgatccaattaaacctatggaggctgccgcgttcaagaacacaaaagacaccgcttctccaccggagaagaaaccttcccaaccaacttcatcaaagaagaagaacagaaaaggcggcctgtcgctgttcctgagcggcgctctcgacgacaccccaaaacc

SEQ ID NO: 81496 - DNA, 356 bp, Zea mays
  Clone ID: LIB3088-044-Q1-K1-G5
cacggagcatgacaccttacgtcacacggcgctgcgaaccggcggattcctgcgggcactgatattccactagcggactaccttcctcgagatatgctgggcattttcaatctatttggaggcaggggctattcttccacaatcagtgtggctccatataatcagaaatgccgataacttaactggacaatatgatttctacattggggcctaccgtgcgttttacattctaaactggatttatcgttatttcacggagggtcatcgcatcagatggatcccttggcttgctgctttcgtgcaaacagatctgtatgcatattgctaccactattaaatcttaaggtcgaagaaca

SEQ ID NO: 81497 - DNA, 434 bp, Zea mays
  Clone ID: LIB3088-044-Q1-K1-G6
cacggaggaggcgatgcggaacgccatcgagggcatgaacggcaaggagctggacggccgcaacatcaccgtcaacgaggcccagtcccgcggcggccgtggaggcggcggcggcggcgggtacggtggtggccgcggaggcggcggctacggcggtggcgggcgccgtgatggcggcggcggctacggcggtggcggcggctacagtggtggcggctgcggctacagtggtggtggcggcggctactgcggtggcaaccgtggcggcggctacggcaactacgacgggaactggaggaactgagcggtggggcccgcgcggtcaagttatcctgttcgctaccgtgttgtttaccctagtccagagtgtttatcttcgatcgtctcgtgtttgttgttgcccatctgtgtttttgattgaaggtcgctctgtg

SEQ ID NO: 81498 - DNA, 172 bp, Zea mays
  Clone ID: LIB3088-046-Q1-K1-B5
atttcgagaatcaactaaccaacaaatccgtagcccaggtgattcgctgcctccctctggccaaaccaaaatgggatgaatcttctcatgcagcttttttcttattcagggcgctgcgaagcatcaaggcaagggggtaaataaaataagggggaagaggagttgtcacgat

SEQ ID NO: 81499 - DNA, 293 bp, Zea mays
  Clone ID: LIB3088-046-Q1-K1-H6
taaccgacatcttcctcatcgcccaaatggcttcatatatctggaactccacgtataaatgtgatggattctgcaacttcctccgtgccacacatactgcatatggaggtccaaagtgagggtacaatactatgccacacacatttgagcgaacaatacatcagtcctctacatgtttcatctactatcacaaagttgcaaaatatatatggtgactatcattgaacttaccgtacctgggccagtgtctctgcctacaccatacctgtgcattgtcagtactatttgctaca

SEQ ID NO: 81500 - DNA, 239 bp, Zea mays
  Clone ID: LIB3088-047-Q1-K1-A10
aaaaaaaaaaacaactatataccttactttttaaaaacttaatacaaaaaatatggggtgggttcaactaaataatgagccttggtcagcaatcctatttatccctttgtcatatacgagacttatctcgttgtaaatttcctttgggttcaaccaaatataatcaactaaccccaactttacatatttgtctaccataataaccctgtcgaccaaatttttaaacactttaatgaaca

SEQ ID NO: 81501 - DNA, 409 bp, Zea mays
  Clone ID: LIB3088-047-Q1-K1-C12
cccacgcgtccgcccactcgtcctctccttcccttcatccggaacgtgatgcaggagcgggtctgctccaccgacgtgctgtacaagctcgtcaaggggtgcgaggagatgctggaccagctcctcctgccccggaaccagcagcggcccgtgccgagcgacaacggcggggaaggagacagcgacggcgacgacgacaagcaacgaccggcggagccaggcgcctcatcgctgcccagcggcggcggcggtggcgctggcgacatggagctggaggagatcgaggacatggagagcatgtacatgaagagtacggtggccgcgctcagggcgctcagggagatcaggagcgggagctccacggtgagcgcgttctccctgccgccactacggtgattgacacgttgtg

SEQ ID NO: 81502 - DNA, 302 bp, Zea mays
  unsure at all n locations
  Clone ID: LIB3088-049-Q1-K1-A7
aacggatatcaagatagaaatgcattaatgtttttgtgatgtgtagtataactgatattgaccccttgatctctaggtacaatagtcgngnnngnnangnnctnnnnnannnctnnancngnnnctgcataccgggggttgggcatatcctgcagttagatgatcaatggtgattagatacatgttctggaaccaatggtcagatgacagatggcatactaaacaccctattggtctctaatattattattgtcttggaattgcaatgcctgtgaagtacattattaatggcaggcccaggc

SEQ ID NO: 81503 - DNA, 328 bp, Zea mays
  Clone ID: LIB3088-049-Q1-K1-B6
agacaaacctgagggagccacagatcccttggcttagctttgccagtgatcaaacatttgtgtgattgaccctgttcacctgctggtatagtcggtaggggggagtgaactaagcgagaggttcgccacatttgatttgaggatgtgtgttgggacattcaaggtattctgtttcttgtccttgacaagggaggtggttgggtgtttgaaggataagagcagtggggtacactttctcacgtttttgtgccccacacgctcgatatctgtattgatgatggtccgtaaaaccaaggtaaatggctattccaaaattttcgtgtttttt

SEQ ID NO: 81504 - DNA, 337 bp, Zea mays
  Clone ID: LIB3088-049-Q1-K1-C6
gctgaaaagattagacgctacattgttgtttaatccatttaccaggtgcagtgcttttgagtgttttgtgttgatttgtgctgtctttttttatatgtccttatgaatgtttggaaaataaaatgtccatttaacctgagcaaataaaaaataaaaaaagaaaataataaataaaataaaaaaaaacaaaaaaaaaaataaaaaaaaaagaaaagtaaaaacaaaaaaaaaaaaaaaagggagtgacattatacaggacccaagtttactacgagatcattgcatcgaaagatttactttatagtgtaacctaaattaaattatatggctgcatttt

SEQ ID NO: 81505 - DNA, 410 bp, Zea mays
  Clone ID: LIB3088-049-Q1-K1-C8
tctagaccgccagcgacccgcctggtaatttgatgtctctgaaattataaaaaaaataggggcatctatcatgaccacaaaagaaaaatatacaataaaaaaaattactaacatgccatacaattcaatgacaagcagcatcagacgcaactttgaacacattacctgactcaagtactggccataaaaaccgaaatagaataaaggaacaatggagagggaaaatagaagaggattcacacaggatccagcaagaattccaaatacaaaacaaggaaaaagattattaacaacaaacaatgattcgatgccttcaggacgatgagatttttcaaccatcaaacaggcactgaaagcttgcttagcaaagcaagcagtacaccttttgacattcattagttttcaaaaat

SEQ ID NO: 81506 - DNA, 439 bp, Zea mays
  Clone ID: LIB3088-049-Q1-K1-D4
acggctacagaacatccgcctagcgtagataattaccagacaagctataatggctctgaatgggttgagctattagtcacagagatgagaaatgcttctgacataaacgatgcacgggctcgtgcgtcaagagctctggaggctttggagaaaacgattgtagagcgtgcaggagctgaagctacacaaaacctgcataaggaaaacatgatgctcaaggagcagttgactgttgttctgcgagagaactccgtgctgaagcgggcagtcgccatccagcacgagcgccaaaaggagttcgacgagaggtctcacgaggtccagaacttgaagcaacttgttctgcagtaccaggagcaagttaggactctagagatgaacaactacgccctcacaatgcatcttaagcaggctcaacagaacagcttcatacctgggc

SEQ ID NO: 81507 - DNA, 240 bp, Zea mays
  Clone ID: LIB3088-049-Q1-K1-D7
tggaggtacaaccggtgaaggggggtgaggaagcagcatcaatggtaagagttctactactgagtgggggaaaaacaacttgcggctgggttagtgaagcttagtagctaccactattcaagagttaaagggagttcgtatgacagttcctctggagatgttatcttcaaagtcttatatcactgctacttgtgagctgtgttaaaacctatatatataagttttgtttgacgtgactgc

SEQ ID NO: 81508 - DNA, 97 bp, Zea mays
  Clone ID: LIB3088-049-Q1-K1-E3
gcagggcctccacgcattcaacctatcatttaaacccccggcgcaacaccaagccacgggaggcaattaaaatagaaccgcggccatccaagaccgg

SEQ ID NO: 81509 - DNA, 395 bp, Zea mays
  Clone ID: LIB3088-049-Q1-K1-G5
gcatcgagcacaccaacgcctgacgaaacatgcaatcgctccaagagaaggggtgcagcacttgctaaattcaggcagaaaaggaaagagcgctgttttgacaagaaggtgaggtatgtgaacaggaagaaacttgctgagacgaggccaagggtgcgaggtcaatttgttaggcatgcaagcaatatggatatcataagcactggagatgatatatctgaagacgaagatgacgatccaacctacagggaggtagatatgatttcttctccagagtagtggaaaggtcctcttgtgtgaaaaattagagtgcagatggttactgctcactttgttacaactcagtaggactagacaatacattcttctactggcaacaaagcaatacacccttt

SEQ ID NO: 81510 - DNA, 298 bp, Zea mays
  Clone ID: LIB3088-050-Q1-K1-A11
taaagagctcaacacctgatcgatccgtgtacagtaagcaacacgttatggaacaattcggcgattgattgtacaataattgaagacaaggtttataactttaaaaaaaaaataaaaaaaataaaaaaaaaaccaaataaaaataaaaataaataaaaaaacaacatctaaacaaaaaaaaaactaaaatacataaaaagaataaataatggcactaattcctaaataaaaaaaaggggttaatgcttataagaatccatgttatatgactcatgaattaaccaatatgattataatt

SEQ ID NO: 81511 - DNA, 263 bp, Zea mays
  Clone ID: LIB3088-050-Q1-K1-G4
gacccagtcctacttcaacgcgcggctccgagctttgcgcactactcgatattcatggctcttgacgtatacgagaactactacctcatcaaataccgcttaccccaggacatctgcttccatctagataatacgtcctctgcacatatctatgtcagattgaataaatgtcagctcaatgtatgacatgatctaggatgacctcgaagactattcgcactttgtcgaagctacttccattcaccctaataaactcaatcaca

SEQ ID NO: 81512 - DNA, 233 bp, Zea mays
  Clone ID: LIB3088-058-Q1-K1-A7
ttgaatctctggaacttgcgattagtgacttgagacctaaagaattttaaaggttcagttgccatttctgcggggcgaaagatgtggtacagatgccaaaaacatcaccgggctggaagtgaaaaaaatcatggagcagtggcatggccgaagagtggcacacgcacaaactactgaggagagggaaagccattggaggagacagcagcccttctggaatatcttgctaacaa

SEQ ID NO: 81513 - DNA, 393 bp, Zea mays
  Clone ID: LIB3088-058-Q1-K1-B5
tgttggagatggaaggataatttgggattttatagcggatgtcagcattcaggtaggatctcatgttgtgtaggctaagcgcactggaaccgaggtcgcgttgaacgatcacagccatctggttctcaaagaggatgacgctataggtatcttagaaactgatgacgtgaaagacatgaagcctctgaacgaccgcgttctaatcaaggttgctgaagctgaagacaaaactccatgaggcctactgcttacggaaactgccaaggagaagccatctatcggaacggtcctcactggtggcccatgccccctggactaggaccgctagaggcttacgctggtcgattctgcgggaacactgtcctgaactcctagtacgtcggcagcgagttc

SEQ ID NO: 81514 - DNA, 110 bp, Zea mays
  Clone ID: LIB3088-058-Q1-K1-E6
accacgcgttcgatcgatcagttttacagtttcaagagaaagagaaaacatgaggaatgttttccacttctcagaggactagaaatattgaagaaagaaaaaaggattta

SEQ ID NO: 81515 - DNA, 382 bp, Zea mays
  Clone ID: LIB3088-004-C12-F1A
taagggggtattgatcaagattccacagaaaatgggggaaggcggcataacgtgtaagggatgaggtgcctgataactgggccccgtaggattaattgggttgaactagatgatcggtttacagtcgcaagtaatgtagtaccacagtaacgttatagatccgcagcacgcgcagcagaagcgatttgggtatcaggaggtcttaaggttgataaatatgtggctatcctaggtcggatggatcggctccagggaccagtattcgggaactcccacgcactggtgccaatagggcaacatgacggggtaatagccaacggcggatataggggaaggggaacgcaagggtgcaaatccctcaagggacggggttctccgcgtt

SEQ ID NO: 81516 - DNA, 370 bp, Zea mays
  Clone ID: LIB3088-001-G12-F1A
gaaatacaataatcccagggttgaacttgaatcccaccagaaacacggagcatccacagaatacacaccagccctagtctaatccaatcgacatcgacagagtaccagtagtctcataacagagagagagagagagagaaaaaaaagaaaagagggcgataacgcaggacaaagctagaatagcacggcccagttccagctcttccgtaagctggttgcttcacttgcagccgtgttggacccggcacggatggttccgtcagaagcaggcgtccaggaggcagcagcagcagagggcagccaagctgttcaagcaagaatacagtcagccattttacataaagtaaagaagagcatatattcccgttcc

SEQ ID NO: 81517 - DNA, 370 bp, Zea mays
  Clone ID: LIB3088-001-G12-R1A
ggaacgggaatatatgctcttctttactttatgtaaaatggctgactgtattcttgcttgaacagcttggctgccctctgctgctgctgcctcctggacgcctgcttctgacggaaccatccgtgccgggtccaacacggctgcaagtgaagcaaccagcttacggaagagctggaactgggccgtgctattctagctttgtcctgcgttatcgccctcttttcttttttttctctctctctctctctctgttatgagactactggtactctgtcgatgtcgattggattagactagggctggtgtgtattctgtggatgctccgtgtttctggtgggattcaagttcaaccctgggattattgtatttc

SEQ ID NO: 81518 - DNA, 478 bp, Zea mays
  Clone ID: LIB3088-001-G6-F1A
cgatgcgattaattatttccgccatttttttacatacggaacgaacggcgccattgccattgcagctgagcttgctgcgtcgcagatgatcgggtaccctgcctgcctccaccagcctatacaacagtcgcctgcctacttccttcgccatacgtacaccgggcacactcacgattacctaccgctactgaatactgatgaccttcttcctcggagacacgacacgagaacggtcctgccggccgtctagcagattggattgggagctacgcctacgcggcggccttggccggcggtatcacgatcgggctccggacgacgtgctcgctcgacacccacttcaggttcccctcggcgccggcgacggccggcggccacgttccaccgcaccgtcacggtgaagctctgcttctcgttcgccctggcgaaccgcagcaccgggggccgcaccaccacggacacggccctgggcatgtca

SEQ ID NO: 81519 - DNA, 446 bp, Zea mays
  Clone ID: LIB3088-001-G6-R1A
cccacgcgtccgcccacgcgtccgcccacgcgtccgcccacgcgtccgtgtcgacgccgcacctgagcggcatcgcggccatcatcaagagcctgcacccgagctggtcccccgcggcgatcaagtcggcgatcatgacgtcgtcgggcacggcggaccacgcgggcgtgccgatcaaggacgagcagtacaggcgggcgagcttctacagcatgggcgccgggtacgtgaacccgtcccgcgccgtcgacccggggctggtgtacgacctcagcgccggcgagtacatcgcctacctctgagggctgggcatcggggacgacggcgtcaaggagataactgggcgccgcgtcgcctgcgccaagctgaaggccatcaccgaggcggactcaactaccgtcgctggtggtgagctgctgtccatccgatcacgtcgccgcacgtga

SEQ ID NO: 81520 - DNA, 170 bp, Zea mays
  Clone ID: LIB3088-001-H12-F1A
agcactcttttttttttttttttttttttttttttttttttttttttttttttttttattgtcatatgattattaaattatcacactaaatcactgaggcatgcatccctgagggaataaagatctgacagctaaaacctgcatgcacaggggctctatagcatggcgga

SEQ ID NO: 81521 - DNA, 470 bp, Zea mays
  unsure at all n locations
  Clone ID: LIB3088-001-H12-R1A
ggacgcgtggggcgaggacgcgatgggacgggacgcggtgggagcccagtccccacccacgaccagtcttcgtgggtctccagatctcgcgacganaaagcccgtctagggcgacangggcgcgccgaccggcgaggaacgacggtagaggagggcatggagccggctgagcggatcgagtcggccgggacgcggctgggggaagcgtccggagggcagggtgctgccgcacacggccagcatggtggacgggtgccgtcggcggcgaacagggggcgccaggagctgagcgccggcgtgccgtcgtcctgctgactggcgnctgcctgctccgggggatggtggccggtaccgggggggttactactactgtggcacctcgttcgcggcgggtggagacggcggccttcctgaaggcgtgcggcctctgcaaactccacctcgggcccggccacgacaccttcatctac

SEQ ID NO: 81522 - DNA, 286 bp, Zea mays
  Clone ID: LIB3088-001-Q1-K1-A11
cggacgcgtgggcttctggtcttcctcgctgctgccgtcatcgtcttgtcctgctgatcgtaatagaatgcttccaaatcgatgtgtcgcatcgcatggtctctttattactactagtacgtacctttttttctttgttcggtctagttgagacaagatttagaattaagacgctggttttgggtggacctcgttaatgatgtaattatatatttgttccttcgtctaaggctatttttaatggtggtttcatgcaaaaaaaatatacaacagtatgactggaaaa

SEQ ID NO: 81523 - DNA, 174 bp, Zea mays
  Clone ID: LIB3088-001-Q1-K1-B11
tgattatgttactgacatcatgtctatatccgaggattgagtcgatgtcatcatcatcatcgtatccttgatagctgcaaaaactggattccataattagttcaattaaaataaatgcagctatcatttttcggatcaaaaaacaaaaaaacaagatataaacctaacccaaac

SEQ ID NO: 81524 - DNA, 282 bp, Zea mays
  Clone ID: LIB3088-001-Q1-K1-H3
ctgagagcgggcacagagtgccagccaccaggtacacacagacaggcgctgtctccaaaggagagagcgttcgttcgctgcttgctcccgggtccagcggcccttggaggctcgaaacccgatcgtggcgtctgcttcgctcgtgtgtgtgtgtgtggatgtgtttttggcgtcgatatgtgttgagaactacgttaccacggatcaccagatccgctccaaaaaaagcaataaataactagtcagactagacactagatcaccaatatctagcacctataa

SEQ ID NO: 81525 - DNA, 460 bp, Zea mays
  Clone ID: LIB3088-002-D11-R1A
agaaaatccacgattgtcaacatatgacagacggctcccctgctgtggctgtggaataggttggtcctgctttcttctaggtttcttgtgccctatcatttggtacgttgcagctcttctctattgctgcaagtactataatcgggatcctcgtgaacggactggactcgcagcttccgctgttctggcggttatcattacagctgtaactattgtaaccctgtctgttctgctgatatgttgtgtcaacaaacggttcttgaatagctgtgcagtttggcctaagtgatagcagcaagatatctattgcaaaacatcagcgttgaactactaactgacatattctttagattctttagtcagtgcacttattgttggactgcaaaacggaaatcaacaaattatgtgtaacatgatccattatcacctgtgactgtacattacagattactggacctgg

SEQ ID NO: 81526 - DNA, 464 bp, Zea mays
  Clone ID: LIB3088-002-F12-R1A
aaactctagctgatgggctgcatattctctcagaggaaaaaacgggaggttgcagtcattgacaggagaaccagccggctaattgggtcattacagtgcagtgatgtctacctgtttctagatgacagcacccttttcagcaagcgaacgacgactactctgcgaagaattaatcagcctgagataacaagaccggcaggagatgcagcaccgctgaaaattcatgtgcgcctggccgggacatcctcgcgctcaggagcaggcagtcaggcatggtgggcctaccagccaccaacctggaatccgacaccctagagcaagctatggagaagctgacaactttaaggagcagctgcagcttcatcgtcgacgagcacgggcgcgtccaaggagtggtgaccacaaggtacatcatctccgtgttctccccgctgtgcatggactcgaggattgacggggccacg

SEQ ID NO: 81527 - DNA, 73 bp, Zea mays
  Clone ID: LIB3088-002-Q1-K1-C3
aaaaaaaaaaaaaaaaaaaaaaaaaaaaaaaaaaaaaaaaaaaaaaaaaaaaaaagggggaaaaaaaaaaaaa

SEQ ID NO: 81528 - DNA, 86 bp, Zea mays
  Clone ID: LIB3088-002-Q1-K1-E3
catacatggcagtgcatgcagatatgtgtattcattctttggcggtgcactcttcaacctgtgcaacgtagacaaagcttgtatcg

SEQ ID NO: 81529 - DNA, 59 bp, Zea mays
  Clone ID: LIB3088-002-Q1-K1-E5
cccacgcgtccgcccacgcgtccgaaaaaaaaaaaaaaaaaaaaaaaaaaaaaaaggaa

SEQ ID NO: 81530 - DNA, 307 bp, Zea mays
  Clone ID: LIB3088-002-Q1-K1-F6
tacccccctgccatggttttattggtcctctgcttgtttctcgttttccttgggagtcagcttctctgttttatgtggtcgcacacggccttatttgtagtattacaccacagaagctggctgacccaaaaaccgacattttgggggcagcaacttaacgaaatgtttgcacgagagtttagagccctatggaacttgtttggataaatatgtttattacgttgtagtacttagctaggaacctgcttatgtaagatgatctttctttaagtaagattaagaactgtcagcggcctagttctgctgc

SEQ ID NO: 81531 - DNA, 336 bp, Zea mays
  Clone ID: LIB3088-002-Q1-K1-H10
cccacgcgtccggctttctgccgccgtcaaggcttctgctgccacctctgcttaagaatattcagtgttttgggatctttgtaaggtctatctcgttacagcgaaagtgcctctctacttagatttatgagtaattgttgcttttttgtatgaacatggtaatggcttgtcggagtaccagaggtttactatgttggtttatgctgtgaacgtaagcgagccatattctttggtatgcagtctgaactatatgttaaaaaagaaaaagaaatacaataacatcaaggattcctaagaaaaactgccaacatcatgtgacaactacttatgacaaaa

SEQ ID NO: 81532 - DNA, 426 bp, Zea mays
  Clone ID: LIB3088-003-A9-F1A
ataaagtagccagcaaattcatggcgaggagtaccatccatttccacactcaaaagatgcaacacatccaaggagaaaaagatgatccagacaatgagaactcaagagttcaccctagaacaacttaaaacacgcaaggcacaactcctgctcaagttcaagactcatgatcctttctactcaatcagatcatcatcgtcatcaggaagaggttgtgcagctgctgcagcaagctcagcttcatgctgctgctgcatagccatgtcgatggtaacttccggaggcttaagagcaacagcttcaacaaagtgaaggttcggatcaccagccagcttccttgcgaggtacaggaaaggtttctcaaagttgtagttgctcttggcagaaatttcatagtactgccggacgcgtgggcggacgcgtggg

SEQ ID NO: 81533 - DNA, 355 bp, Zea mays
  Clone ID: LIB3088-003-A9-R1A
cccacgcgtccgcccacgcgtccggcagtactatggaatttctgccaagagcaactacaacgtttgagaaagctttcctgtacctcggaaggaggctggctggtgatgcgaaccttcacgttgttgaagctgttgctcttaagcctccggaagttaccatcgacatggctatgcagcagcagcatgaagctgagcttgcaagagcagctgcagaacctcttcctgatgacgatgatgatctgattgagtagaaaggatcatgagtcttgaacttgagcaggagttgtgccttgcgagactttaagttgttctagggtgaactcttgagttctcattgactggatcatctttttct

SEQ ID NO: 81534 - DNA, 200 bp, Zea mays
  Clone ID: LIB3088-003-Q1-K1-A11
cacaagctgtactttgtcatgtccctttgagtacgcatcagtgtcatgcaggtgggggtggcttgtagtggtccgtttaggcggtgtagtcatgggaacgcgacatcagatacctggtttcttttgattgtgatgttatcttgcattattgcacctgtaggatttgttgaagctcatattttccagggttttggatcttt

SEQ ID NO: 81535 - DNA, 215 bp, Zea mays
  Clone ID: LIB3088-004-C12-R1A
gtccgtctgtctccactctacagatgtgtcgcttcgtctctctcctctatgttgcgaccccctatcgtgtgtgattctatcaattattctacggttagctcgtctcgcttcgcgatggtcaagggctacctcgtcgtgcctcagggatctgccgtcgcaacagttacgaaggtcaagtggttggtggtcaagcactggagcgccgtatctctctg

SEQ ID NO: 81536 - DNA, 254 bp, Zea mays
  Clone ID: LIB3088-004-C12-R2A
cgcacgtttgtctacactatacagtcgcgccaactggtcgctctcctctctgccgcgcccgcctactgtgcgagattgtattcaggacacaagggcacacaagacacgagtcgcgatgatcaagggcagcgtctgcgggcccccatgcgctggctacctcacctcaaataaggccaagtgcctgccgatcaagaagtggaacaacctgtctctctcagcccgtgacagaatggtggacaactgcgccagatgcc

SEQ ID NO: 81537 - DNA, 405 bp, Zea mays
  Clone ID: LIB3088-004-F5-F2B
gatggaaaatacattattcttcgtctcgatttattagtgccgcatgttcacaagatgcatcatcgtacgattccggctcaaatgcagggaaatagttcaacatttgcatacgcctgtgattgctacaaggtttccagagcttcacttttttggtgtatctgcatacttccaggaggtatgtgcataggaattgtattgtcttccaccagccacatcttctgcacgtatctggctgccaatttccttcaggtcctcagctgtgagcttcaccttcaaggagtcaacgttggcatctaagttcttcgtttttgttgtccctggtataggaaccacatcatccccttgatgcagaacccaggctagagctagctgagctgggctgcactggtacttcttggccaaatc

SEQ ID NO: 81538 - DNA, 367 bp, Zea mays
  Clone ID: LIB3088-004-Q1-K1-C10
cccacgcgtacgaaatcggcgcatgtgatctcctctgagaaagctgcagcggtgccacgtgtgtccggctaagagttaagatgcctttcgaatgtgaacccaataataatgcggtgcgggtgcggccgggaaatcacaggccgaaccgaactgctgaatgaaagagaccactcacgctgctgctgtgtcaggtcagcgacgagacttttgctccagctgccggggaccatccaaaaccagccattatagatcaaatcaagtagagtttaagtgctaggaaataattcaatgcatggtgtatctttggtaacgtgacatgacaacaatgcaatgcaacgcggcgggtttcaaaaaaaaaaaaacaaaa

SEQ ID NO: 81539 - DNA, 382 bp, Zea mays
  Clone ID: LIB3088-004-Q1-K1-C11
gcgcccacgcgtccggcaagcacggtgctcaaactcaccaaaacattgagaaacgccttttgagttgcaggtagatgctctatttataccggtgacaatcgcctcttctggcttttagcagtttgatggctatctttacttagctatataatgtatctgagactgcaaactttgtgtcactgaaactgctcgaggttatatgctaaaaaaaagctccaactgtcaaggaccatacaaaaccagccattatagatcaaataaagtaaaagataaagtgctaagaaataattcaatgcataaaaaaaaagggggtcccttttcaaggctccaatgttacgtacccgtgcatgcaacgaaaaaatttttcattagggtcacctaa

SEQ ID NO: 81540 - DNA, 323 bp, Zea mays
  Clone ID: LIB3088-004-Q1-K1-E6
acgacgccatctccaacgtctacgtcaacatcttggaacacccaaaacttactagggtcagggctcctttatcacaccatcaccatacttacaacactgctaatctccaccttcaaagtaaaacacgtcgctaactgcacacaggtctacaatatctctaaaaacacatatgatcagaaaatctccatacgtcatcttccactcctaatgattaccagtcctaacatcacccaaaaactcataaatatctcgattcaacatcatactttattacctattacatgcctcatgaatttaactgtttacatgatcatcagaaacct

SEQ ID NO: 81541 - DNA, 202 bp, Zea mays
  Clone ID: LIB3088-004-Q1-K1-E8
cccacgcgtccgctgacacgtgggtcgacgttgatgatcctgcaatgttgtaggtgattggggcatttgttggccctgctgctgaccacctatgtggctgctatacactgtacctgtctatgcatatatgagactggaacatttggcgcataaaaaaaaagtatacataataatggcaaggcacattatacatatataatat

SEQ ID NO: 81542 - DNA, 421 bp, Zea mays
  Clone ID: LIB3088-005-C12-R1A
acgcgtcaaactgctacttaatcagctctttgacatcaaaagcacggaacaagaattgctggatctcaataaagacctaaggaagcagctgcaagaaacaaggccagagaacgcgctccgtgtctcctgggaggaaggtgggcacagtggcgcaagtgggaatgttcttgatccttatcaggggctccttcagcacctggacaacgatccttccctgcagttcgggtaccatcatcaagcctacatggatcagctgaacaacgaggacctggtggacccgaatgagcatggtcgatctggatggatatgaaatgctctgatgacccaaaataaagttgatgcacagcagggattcaccctgcaggacgcgagactatgtattgacactaagacctcgtgtgtgtaatgttgtgtgcgaact

SEQ ID NO: 81543 - DNA, 394 bp, Zea mays
  Clone ID: LIB3088-005-Q1-K1-B4
cgtacatagagttctccataccattgttcatgagcagggctccctcgacagttctaagggggagagcttcgtgaagaatctggaaatggagggcagatatctgagggatgtgtggtaaagagcgattggatgaacattcgttcgtattacacacgtgtacaactactaccggaagagcactgacaatggactagatctgatatttttattgcttctatatttatttttattttcttttgcttcgttctcttcaagagctctttgctttctttgcggttctcccaagagttctttgtacctatgtattacaaattctttatatgtataagatgaggacaattttggcaaataaaaataaaatttatatattcaattaatttttaaattttttaaa

SEQ ID NO: 81544 - DNA, 64 bp, Zea mays
  Clone ID: LIB3088-005-Q1-K1-B8
aaaaaaaaaaaaaaaaaaaaaaaaaaaaaaaaaaaaaaaaaaaaaaaaaaaaaaagaaaaaagg

SEQ ID NO: 81545 - DNA, 295 bp, Zea mays
  Clone ID: LIB3088-005-Q1-K1-E2.F2
taccggggttttttttttttgggagattgactagattgatggcatcactgcggaggatgcagtttttacatagcccgcccagttaagttctcatcggaactgatgatgctcatacatgctctggcatgggcagatcatcgctgggcatgcctagcgggggggggcctggatgacgtctaggccaacctcggcggtgtcggaggcctggagctccacctgcatgtcgtgcagcttctggttgtacctgttgtttgtgctggcgtctatacatcccgctcctcacgcgcgccgggtc

SEQ ID NO: 81546 - DNA, 197 bp, Zea mays
  Clone ID: LIB3088-006-Q1-K1-A8
cgccaagcacgccgtctccgagggcaccaaggccgttaccaagtttacttcctcttagatcgccgccgcacggagcgacggctctgtttcgtttcctcgtacttttaggccagtgctaataggttgctcgaggaacaatgtactgtggaaatttctaatatattccaaattgtgctgataaaaaaaaaaaaacagca

SEQ ID NO: 81547 - DNA, 349 bp, Zea mays
  Clone ID: LIB3088-006-Q1-K1-B1.F2
taccttgttttgtgttttttaaaatatttttttttttttttttttttttttttttttttttttttttttttttttttttttttaacgagcatggcaggatctatatatatgagtaaagatgttcactgacaacttgctagatttttatttcatatacggggtggacaaaacaaatttgcgcgaaggaccaaaaaagacctagctagattttcctgcaaaagctaagcccttcaactgaagatacagaccactaagctttacggccccaaaaggtgatatactacttccatagaattaagagcaatcatccttataggtttttcgtttttcccttaccaaaatgactgtt

SEQ ID NO: 81548 - DNA, 288 bp, Zea mays
  Clone ID: LIB3088-006-Q1-K1-E11
cccacgcgtccgcccacgcgtccggtagagagttatcagattaaaatatctctgatgtgcttcgttattgggtggaatcatgtgtcccagcagtgctgggaaatcgagatcaagatgtatctttctttgcagtaatgaaatgttaaaatcgagatcaagatgtatctttctttgcagtaaagaaactttgctattgcgcccaaaaaaaaaaaaaaataaaaaaaaaaaataaaaataaaaaatcaaaaaaaaaaattaaattttatttaaaaaaaaattaaaatataa

SEQ ID NO: 81549 - DNA, 93 bp, Zea mays
  Clone ID: LIB3088-006-Q1-K1-F5
aaaaaaaaaaaaaaaaaaaaaaaaaaaaaaaaaaaaaaaaaaaaaaaaaaaggaaagggaaaaaaaaaaagggggaaaggaaaaaaaaaaaaa

SEQ ID NO: 81550 - DNA, 294 bp, Zea mays
  Clone ID: LIB3088-007-Q1-K1-A6
accactcgtacggccacgactatacgaacccaaagctaacagatgctgttgggcagaagtgggggagaccctttgagaacctatatacttttgatatggaaaatcatatacagttcacttagtctgtttaacattcgatttcacttgctccaaacgaaaaatgcgatccaatgttcgtgcgatttctgtgtaaaactgttatacttttaactgtcctcaactatccatttttttatatataatgtcttggtgttaaaaaaaaaaaagggcagaagatataaaggaaccaaaaat

SEQ ID NO: 81551 - DNA, 598 bp, Zea mays
  Clone ID: LIB3088-007-Q1-K1-B4.F2
agagttggaaccctccgcgaactagttccaggcaccacttccatatcgtattttgtacatcaacccattataaaagcagtgaagaagaacatctcattctccagtgacatggcatggcttggcttggaagcatcaatcgtcgacagggtcctgaggagcttcggtagcgttccgttttatggtgatgacggggcattcggcatgcttaacgcagaactcgctcaccgtgcccacgaaaaccctctgaaatggcccaagacccctacttcccacaactagaaggtcaggctggactctcttcacttcgctgcagataacctcctttggatctccatgtctgatccatgcctcgcattttatccctaactgatggcattggtttacaaagtactcgagcaaatgaagccctcttatcttgtctctctgcttcatttggtgaaagtcctccggcgaagcatagatgctatccatgtcatcaaatccgtcctcgtcggggacatgaacgtggacgaagaggaagtggaagcccccagggttggagcggacgagcttggagagcgtccagtcgaaggcggtgcgacagctgatggaggggtgc

SEQ ID NO: 81552 - DNA, 654 bp, Zea mays
  Clone ID: LIB3088-007-Q1-K1-B4.R2
cccacgcgtccgatttcccccaaaacttctcctcttgaggaaggcagcccgagcgagcgcgctgcaatggcggactcgtcggcgccgacgagagtgatgatggcggtgaacgagtcgtcgctcaaggggtacccgcacccctccatcagctgtcgcaccgccttcgactggacgctctccaagctcgtccgctccaaccctgggggcttccacttcctcttcgtccacgttcatgtccccgacgaggacggatttgatgacatggatagcatctatgcttcgccggaggactttcaccaaatgaagcagagagacaagataagagggcttcatttgctcgagtactttgtaaaccaatgccatcagttagggataaaatgcgaggcatggatcagacatggagatccaaaggaggttatctgcagcgaagtgaagagagtccagcctgaccttctagttgtgggaagtaggggtcttgggccatttcagagggttttcgtgggcacggtgagcgagttctgcgttaagcatgccgaatgccccgtcatcaccataaaacggaacgctaccgaagctcctcaggaccctgtcgacgattgatgcttccaagccaagccatgccatgtcactggagaatgagatgttcttcttcac

SEQ ID NO: 81553 - DNA, 358 bp, Zea mays
  Clone ID: LIB3088-007-Q1-K1-C5.F2
aataagaagagtaccagatcttaataagaagagcatgccggtgacattgttttggcaatcagtgtcatggctgctacgacagacttatttcgaaacataggacagtgcttattcaacattgttatacaatcaagacggtggtgtgtttcggggttttcgcaacaatggagacagcatggaggcctgagctaagctcatccctcagaagatcatacactatgctgtgacgctttacaaggttttgcccttcaaattttggtgaaacaaccttgatgttgaagtgcttttcgttcgtattgtcctggactgctgccttgccctgaatgttggtaagaaaactttttaatattttattcac

SEQ ID NO: 81554 - DNA, 347 bp, Zea mays
  Clone ID: LIB3088-007-Q1-K1-D3
ggaggagatggcggtcacgatcacgtgggtgaaggctaggcagatcttcgacagccgcggcaacccgaccgtctaggtggacgtgggccttagcgacggcagctacgcgaggggggccgtacccagcggcgcatccactggaatatatgaggccttggagttgagggatggaggatctgattatcttggtctcccgctccatgcattccaagattctgtcctccccctccctccccccatgttgtaggctggtagtggtcaaattagttggccctgggtccatttggactgatgtattgtttactgctattgaagtcattcgttctaaaaaaaaaagaatttaaaaa

SEQ ID NO: 81555 - DNA, 611 bp, Zea mays
  Clone ID: LIB3088-007-Q1-K1-E5.F2
aataagaagagtaccagatcttaataagaagagcatgccggtgacattgttttggcaatcagtgtcatggctgctacgacagacttatttcgaaacataggacagtgcttattcaacattgttatacaatcaagaccctaactctttcggggttttcgcaacaatggagacagcatggaggcctgagctaagctcatccctcagaagatcatacaccatcctgtgacgcttcacaaggttctgcccctcaaattttggtgaaacaaccttgatgttgaagtgcgtctcgttcgcattgtccttgacggctgcatgcccggcatgttggtaagaaacgtcttcaatatctagggcactggcctccaaggcagactgcagtttttgcctcatccgagcagcccttgaaagcacggcactggtgcctcgtgaagccatcatccatatagtgctcgcagcccagttattatacgttgaaaccagagaccgtgttgtgtcgaggcgatgtgagctcctcaacagtggcggcggctgggctggaggaaccctggttagaaatgaatctgaaagcagagaccggccgcaaagcccacgcgtccgcggacgcgtgggcg

SEQ ID NO: 81556 - DNA, 645 bp, Zea mays
  unsure at all n locations
  Clone ID: LIB3088-007-Q1-K1-E5.R2
cccacgcgtccgcccacgcgtccgcccacgcgtgcgcccacgcgtccgcggacgcgtgggctttgcggccggtctctgctttcagattcatttctaaccagggttcctccagcccagccgccgccactgttgaggagctcacatcgcctcgacacaacacggtctctggtttcaacgtataataactgggctgcgagcactatatggatgatggcttcacgaggcaccagtgccgtgctttcaagggctgctcggatgaggcaaaaactgcagtctgccttggaggccagtgccctagatattgaagacgtttcttaccaacatgccgggcatgcagccgtcaaggacaatgcgaacgagacgcacttcaacatcaaggttgtttcaccaaaatttgaggggcagaaccttgtgaagcgtcacaggatggtgtatgatcttctgagggatgagcttagctcaggcctccatgctgtctccattgttgcgaaaaccccgaaagagttagggtcttgattgtataacaatgttgaataagcactgtcctatgtttcgaaataagtctgtcgtagcagccatgacactgattgccaaaacaatggcaccggcctgctctncttattaagatctggtactcttcttatt

SEQ ID NO: 81557 - DNA, 311 bp, Zea mays
  Clone ID: LIB3088-007-Q1-K1-F8
cccactcgtcctaaaaaaattaaaaaaattataaaaaaaaaaaaaaatatagaaaatagtgaaaatttaaaattttcattagcataaatggacactcattcttcatgttccaatcttccttactctaccttcctaggccatagtttttcatttactgtcacttaaattcaattcactgtcctcaactttataccttctcatctgttaaaacttttgccttccttatttatatcgtattggcccacatccatctttcttcatatcctttactctcatctattcccgaatagatcgccttttctaacatttct

SEQ ID NO: 81558 - DNA, 280 bp, Zea mays
  Clone ID: LIB3088-007-Q1-K1-G6
aacggttaccagactggccaggccagggatgaccaaactgtgctacaacggacggaccggaagaagctgaacgtgaaatccattgtgaagaccctcctgaagtgagtgcaccaccgtgttgaagtgcagtctgcccaaagtctgttatctattgtatccccagtgacctttgtcatcctcatgttggacgtcgtcgtgtatttgtaactgtcggagttgcaacaaaacttgtgtgcttgcgtcaacgtgtgccgtcttgctctaataatgcactatctgc

SEQ ID NO: 81559 - DNA, 235 bp, Zea mays
  Clone ID: LIB3088-008-Q1-K1-B1
gaagaaacatgtcttgtaagatactccttcaaaggatcgggtgcctgtagctgtactctgacacctgcatggattgatgtcttgatgatgtagtgcaatgtagcattcagaacaataaagacatgtttcggactgcaaaaaaaaaaaaaaactaaaaacaagctaaaaaacaaaaaaaaagaaccaaaaaaagacaaacaaaacctacaaaaaaaagccataatggcaacaagtg

SEQ ID NO: 81560 - DNA, 89 bp, Zea mays
  Clone ID: LIB3088-008-Q1-K1-C3.F2
acccggtttgtttttttaaaaaaaaaataaaccatgatatacctccgtgatggtctgctctggcagatttacaaacctttacaaacact

SEQ ID NO: 81561 - DNA, 308 bp, Zea mays
  Clone ID: LIB3088-008-Q1-K1-E7
cccacgcgttctctgactcgttttcagcaatgcttcactcaaaacaacaaactgggcctggccacatacataattcaacaaactaataaaaatcaaacacatcaacactgacaaaaaccaacaacaatggcccaatctttcccaaacccaagcttccctacccttacattctaagtcatagctcttataatttttaacctaaataaacttcaatggcctcaagtttccaactttctttattggaaaaacccctggctttcccaacttaatctagttgcaacacaaccccctttaggcaattcctaaaa

SEQ ID NO: 81562 - DNA, 293 bp, Zea mays
  Clone ID: LIB3088-008-Q1-K1-G12
cggacgcgtgggcgtttttgtacagacatgtcatcagccataatttatccggtcaattggtgtttcagattctatataaatggcagacaccactcggctccattaaatgccgtatctgataatctgttgcctaaattagctcagctaaatattgtcgttactaccctatgttactgctctcttggagtcttggcccttgcagtagtttggtattggaatttcttttcgttagcaaacatgctgagacatttagttgaacgaacctgagttgttccgagaaaaatactgaaaca

SEQ ID NO: 81563 - DNA, 347 bp, Zea mays
  Clone ID: LIB3088-008-Q1-K1-H6
aataaacttgattaacaaagctaagcttagatagttgggcgaccataaagtaccaagcagacgatgtaactcacataaaaaaaactatgttccgcattgcaatgtttcgcagaacaagacctcctagaccctcgactggatttcgacatctagcctgcgtagccatatccagagatcttccagaccctgatagacccatcggtgtagccagtgtagagggtgcttccatcggcgctccagctcaagcttgtgcagtacaggatctggttcttggagatctggatgtcaggcttgaagtcctgcacgacgtgcttcgactcaaggtcccagatcttaacagagtccct

SEQ ID NO: 81564 - DNA, 240 bp, Zea mays
  Clone ID: LIB3088-008-Q1-K1-H7
agtgctaggccatcgattctacttgcactcgtctccatacattgacagatgtacaggactgggacagtaaggtcaggtgaaatcaacatagaagccgaagtgattgcattgaaggctgaactcgcccgatgtagacccataattgaaagcaacttgattgagattgcagtaccttaccatgcatgtcttaagtagcataccataatctataacgaatatgatttatgtgacaacaattta

SEQ ID NO: 81565 - DNA, 112 bp, Zea mays
  Clone ID: LIB3088-009-Q1-K1-E12
aaaaaaaaaaaaaaaaaaaaaaaaaaaatttaaaaaaaaaaaaaaaaaaaaaaaaaggaagaaaaaataaaaaaaaaaaaaaagaaaaaaaaaaaaaaaaaaaaaaaaaaaa

SEQ ID NO: 81566 - DNA, 389 bp, Zea mays
  Clone ID: LIB3088-009-Q1-K1-E4.F2
gatgttaacataactacttggtacagtgatcatgaacaagtaaattgaggccgaatttgttgaatgtcatgcaccagggaagcatgtgtatgtactactcaagtgggtaaaccccaccaggctacctgaagagtgggtgagcacttaaaaacaacttttaacggtaccagagaatgcacacggggcctcctgtattattataagcacatcggggcttgtacctaatgccaaagaccatatcaatctcgtcctcacttgtccaagggattacgaatttgtgcttggctcaaatggcaagatataggaccagataattggcctagacattattagatgcacacgatatattataattcctcagatgttaattttgtaaaggaacgtgccta

SEQ ID NO: 81567 - DNA, 349 bp, Zea mays
  Clone ID: LIB3088-009-Q1-K1-E4.R2
cccacgcgtccggtgcatggaatacccacatagtgcttggctcatcctctgttcatcccacgataagggctgccggccttacatgtagtggaactagctaccgccactcgaattgcttggatcagttcaagaaagcatacaccaagggggcattgcttgaggaagttcctgcaaatagcgttggcactgatctggattcagcgccattggatgcataaaaaattgagtccattgaccttgcatgtccattgtgtcgtggcaaggtgaaagggtggacagtggtagaaccagctagatgctacctcaatgggaaaaagagaacatgcatgcaatgactgatgctcattac

SEQ ID NO: 81568 - DNA, 185 bp, Zea mays
  unsure at all n locations
  Clone ID: LIB3088-009-Q1-K1-G5
aagaaagcacanaatctctggtagaagtggacatcgtcaaggaaaacataagcatagagagaaggctagtactcagcctgatgctatacctcaagctccagtcattcaagatttccttctgtagcatctgagagactcatttggtacacttgagttacccaatatatgtgttttttttgttcctt

SEQ ID NO: 81569 - DNA, 392 bp, Zea mays
  Clone ID: LIB3088-010-D9-F1A
atgataatgcttattggtaagtgatttatatttttacaacataagcagttggatacattcaagcgtgcaccgttgcagcccttttgcatggtgctaaaggagctccgtaggcagggatcaccatacgatcaagagagcattaacgtatccatgacaatgtggtcatttgcacagttcagcaagcacggccagtcccaaaggggcagggaaaacccgcagcatcggtagtcgggatctgccaagcgtcggggatttctcatggcgatggtccctcggcatgggcacgagttctatgtaggccagcccatgcatcgcgctcgaattggctgccggtccatcccgacgctatggcatgtaggtctcacagatccgttgctctcaagagcctcgaa

SEQ ID NO: 81570 - DNA, 351 bp, Zea mays
  Clone ID: LIB3088-010-D9-F2A
actgtttattttttcatgccgatggttattgctaagtgacagatactctcaaaacataagcatcctccacccattcaagcgtgcatcgcccgggccattttgcatggcgctaaaccagctgaactggtcgtgagcaacataggataaagacagctgttacctatatattaccatacggacattcggacaggtcagtaagcaccgcatgcatcaaatgggcaggcaaaagctgtattaaagctcgctgggatctgtgatggccaggacacttttgaaggcagtggaatgaagcactggctaagacattcatgcaggatagcagccgtccggcgctggcactggcttgctggt

SEQ ID NO: 81571 - DNA, 275 bp, Zea mays
  Clone ID: LIB3088-010-D9-R1A
tagcgatgaacactatccaagtgtatacaatttaggacgcagttagactggtatttaacacttagcttgtgctgtaatttaccattcttgtaacttagtatgaaaaggctatggctgttgtctcctggaattcggaatgccgtaccatgtttcgatccaagtcactcctttagacatgacttcatgggggcttggaagactcaagtgttacttgatggacattgtgactgagagtcaggggagcaaatggtgcaaggggcttgatgacacgaggc

SEQ ID NO: 81572 - DNA, 306 bp, Zea mays
  unsure at all n locations
  Clone ID: LIB3088-010-D9-R2A
tagaaataaacaaaatctaggtgtggacaaagtatgaggaatntaactgggttttaaaacttacatagtgctgcaattaaccattcttgnnatttagtattaaaaggctattcctgtttnctcctgaaattaggaatgccgcaccatgtttctatgcaagtaactactttatgcatgtcttcatttgggtttggcagactcaagtgttacttgatgaactttgtgacttaaagagaaaggaacaaatgctgcatcaagcatacagggttctgaaaaggaagctgagctagtttgaggcagaggcgg

SEQ ID NO: 81573 - DNA, 225 bp, Zea mays
  Clone ID: LIB3088-010-Q1-K1-B11
tcgtgggcggacgcgtgggcggacgggtgggcggacacgtgggcggacgcgtgggaaaaaaaaaaaaaaaaaaaaaaaaaaaaaaaaaaaaaaaaaaaaaaaaaaaaaaaaaaagggaggaggttaaaaaaaataaaaaatttataaaaaaataaataaaatataataaattataatgtgtgtaattttataaaaaataaaattttacttttttttaaaaggaaa

SEQ ID NO: 81574 - DNA, 273 bp, Zea mays
  Clone ID: LIB3088-010-Q1-K1-E8
ggcttcgagatggggcaggcgctgggcggccacatgaggcggcaccgcgaggagaggacgacgggcgccgccgatgcctgggtctggcgcgccgacgacgcgctgcagcgggcccgcgggggcgccgccgacccgcccgtcttgctcgagctcttcgcctagctagctagatgatccgtagcggcggcattgattagtatataatccacccaggacatgtaaatcttcttaggccctgtttgggaacaaagtttttgaaaaccacagtttttg

SEQ ID NO: 81575 - DNA, 114 bp, Zea mays
  Clone ID: LIB3088-010-Q1-K1-H9
aaaaaaaaaaaaaaaaaaaaaaaaataaattaaaaaaaaaaaaaaaaaaaaaaaaaggaaagaaaaaaaaaaaaaaaaaagaaggaaaaaaaaaaaaaaaaaaaaaaaaaaaaa

SEQ ID NO: 81576 - DNA, 77 bp, Zea mays
  Clone ID: LIB3088-011-Q1-K1-G6
gttgtaatgtaagggagatgtttaaattcttgggggatagttgtatgatggtgccagcgatgatgcagtgttttctg

SEQ ID NO: 81577 - DNA, 324 bp, Zea mays
  Clone ID: LIB3088-011-Q1-K1-H6
tcgaccacgcgtccgcacacgcttccgggctatggaagcggtggtggcggtggacgtggcggtggtcaaggtggtggtggatatggctatgggtctggatccggctccggttatggaggtggcaacgacaacggacattactaggctctttttcagagctaggaacatgttatacaaatatgtcaccagacatgactaaggcttgctgcatgggatgctagttgtgtccatcgcgtgtgtaacaccgcaaggcttgtaatttgtactgtaaactgattgctgctttacattactggcaacaactaagcgataaaataaaactga

SEQ ID NO: 81578 - DNA, 314 bp, Zea mays
  Clone ID: LIB3088-012-Q1-K1-A1
gatgaggcgaagccaagaaaaagtcgatgtgtgtgtgtgtgtgtgtttgtaagttaaagggccaaaatgtatttcttgtttggtatatagcatctctacaacactttggtgaacttagttactgcaaattaggtaattacagttgcaccttttgtattttatagcaaacccagacttctatttgattctatgactgcccctcttgtagtaaatgcaaggcttcactggtactcctgtttaaagattggtcaaatagaagagacgacggtgattgtctgattgagataaaaaaaaaaaaataaaaaaaagaaaaa

SEQ ID NO: 81579 - DNA, 308 bp, Zea mays
  Clone ID: LIB3088-012-Q1-K1-C6
gcgatctagaacggataggctgaacgccgagaagaagaaagaagcgaagaggctggcgcttgccagggtggacgagaacgtttgccgatcgatcccacgcaaaggggcagggcagcagcggaacctgaatctgcaacaacactaacccagggaagaagctggctctgaagtgtgtgcgtgtgcgtccatctagcacctgtggtgaaaccatggtttctcctttacccgtcggctaggcatctaacttatgtgtgatttgcgtgttcgcttggaaatgaggcctactaaaccgattcggctgtgtttta

SEQ ID NO: 81580 - DNA, 85 bp, Zea mays
  Clone ID: LIB3088-012-Q1-K1-F3
cccacgcgtccgaaaaaaaaaaaaaaaaaataataaaaaaaaaaaaaaaaaaaaaaaaaaaggggaaaaaaaaaagagagaaaaa

SEQ ID NO: 81581 - DNA, 396 bp, Zea mays
  unsure at all n locations
  Clone ID: LIB3088-013-Q1-K1-A1
cgacaggcggtctggcaaggagcttgagaaggagccaaagttcctgaagaacggtgatgctggtatggtgaagatgataccaaccaagcccatggtggtggagacattctcagcgtatcctcccctcggtaggtttgctgtccgtgacatgaggcagacggttgctgttggagttatcaagagtgtggagaagaaggacccgaccggcgccaaggtgaccaaggcggctgccaagaagaaatgatgcgatcctgcgcctgctttagcaatacctagttttcatcatcacaagttttgtttgtgatcgttgctgttatcgtgtgaactgttgagatctgttagcatgtgcacttttatctatntatttggtaccatcttgctatttaaaaaanaaaa

SEQ ID NO: 81582 - DNA, 229 bp, Zea mays
  unsure at all n locations
  Clone ID: LIB3088-013-Q1-K1-B4.F2
ggggggggggnaaaaaaacagcngccnnggcaangccgggaagacccaccgcagggnacggccgaagaaaggangccacaggccacgaacagaagaccgcacaccaggacgacgccaggaacccaagngcgcaaaacgacacgcccggggggggaccaggacagacnacacacccacccaaaagacccaacacagagaagcaggagcagagccaccggaagaaccagcc

SEQ ID NO: 81583 - DNA, 175 bp, Zea mays
  Clone ID: LIB3088-013-Q1-K1-B5
acgtaaacaggcgaaataggtctttattgcgctgggaaaagtttgcgcttgatgcgtaataatgtttaggacggcaacgctcttagagcgcaggttttgttcacctcctgtaccgaggaatgcttactaagtcccatttcacattatggtctttatgaaatagtgcacctcggtt

SEQ ID NO: 81584 - DNA, 348 bp, Zea mays
  Clone ID: LIB3088-013-Q1-K1-C2
acggtcggcgtggcggtgctgaatcggggcactgggacagttcctgtaaagattgaacctttggctgttctgatgtgcagtgaaattagctagtaacttgttgtcaagctgtttattttacaattttagttgcgatgatgtagcaattgggagcatgtgaattttaatcatatgtgatatgacagttttgaggaacgattggaagccacagatctgcagctaatagccccatttgccatgcccatattcctgcagttagttgctaggtccattaattgttagcattagttgggcatgcatgtggtccataatctacatttcagatcaaaaaaaaaaaaaaaataaaaa

SEQ ID NO: 81585 - DNA, 481 bp, Zea mays
  Clone ID: LIB3088-013-Q1-K1-F1.F2
aaacaccaaacgggggattcgtcattcaaattcagggttacttgatgtccgaaaagaaagataggaaacaagtacaggtctgcatcccagagagaggggtggagagcttcaccccgattctttttgcgaagcggggagcaaactacaccaacctatcctattccttcgtcatcgagctagactttaggcaggcagggaaccccacatcacattttccacgtatacccgacggggctgcggacaacgtgctcattgttgacccaggaaatccacccgaagtccggcttcgcgtggccttgccgagccctggacgcaaaggggacataaaacctgagcttcgggccggcctgcctgaacgggagcctcgccggcgtcaccgggacggcgacggacttggggccgaccaccttcacgtcataaaccgaccccgcggggcccacgttggtcagcccccttctaaaacgcagggccgcccccggct

SEQ ID NO: 81586 - DNA, 533 bp, Zea mays
  Clone ID: LIB3088-013-Q1-K1-F1.R2
ctggccttttggacgggcgtcgctcgaccgaccggactcgccaaagacggccgtcggactcgcttcaacatcatctcagggacttcgatgtcatgccctcacatcagcggggtggcggcgctgatgaaggcggcacacccagactggagcccagccgccatcaagttttcgctgatgagctgcgcctacaccgtggacaacacgaactcgtcgctccgggacgcggcggacggctccgtcgccaacgcgttctcgtacggcgccggccacgtggacccgcagagggcgctttcgccgggcctcgtgtacgacatcttgacgcacgactactccgccttcctctgctccctcaactacagcgccccgcacgttcaagtgatcaccaaggcgtccaacgtctcgtgcggccccccgaacaagttccgccccggggacctcatctacccgtccttctcggtggttgttcggcgcccagaatcggaagacgaatccggcggcggccctgcgttttcaggagggagctgaccatacgt

SEQ ID NO: 81587 - DNA, 84 bp, Zea mays
  Clone ID: LIB3088-014-Q1-K1-A11
cggacgcgtgggtgggtcaagttgtgtgtgtaaaaaaaaaaagaacataataaaaaaaagaggggaaaaaaaaaaaaggagaaa

SEQ ID NO: 81588 - DNA, 63 bp, Zea mays
  Clone ID: LIB3088-014-Q1-K1-A5
cccacgcgtccgcccacgcgtccgaaaaaaaaaaaaaaaaaaaaaaaaaaaaaagaaaaggaa

SEQ ID NO: 81589 - DNA, 403 bp, Zea mays
  Clone ID: LIB3088-014-Q1-K1-B10
gcatttgcttcgacaataacgttgcatattccgaacggcgatgtcatcagcctcacaggagatgggcgtgcggataagaagagctcacaggattctgctgcgttgctcatgctctatgagctgcagcggcaacgtagattccaagttcaagaagtatgaggaatcacctcgtggttccatcaccaaagatgcaatgttaccgccaccggcgattattgcttgggcatcttggagtaatgtcaccgccaaatcagtctttagtcgtcagccgcacgggggtgtaagaaaataatgtacttcattctgattctaaattataagacaccccgaattatgtaatctaattatcataatgtcctataatttgaaaaaaaaattaccaacagttgggcaaccttgaaaa

SEQ ID NO: 81590 - DNA, 82 bp, Zea mays
  Clone ID: LIB3088-014-Q1-K1-C5
aaaaaaaaaaaaaaaaaaaaaaaaaaaattaaaaaaaaaaaaaaaaaaaaaaaagaaaaagtgaaaaaaaaaaaaaaaaaaa

SEQ ID NO: 81591 - DNA, 324 bp, Zea mays
  Clone ID: LIB3088-014-Q1-K1-E1
acgcgctgcaatgatatcttaggattcgttagagtcacaagaggcatttcttgatgctgcaatcaagcattcctcaattccaccatgaaaataaacaccatctactccctcgtcaacagcaccgccgcaatgcagtaaaagcaccaagccatcttggttgctccttacgcggaggtagcaggcagcagcgggatcaagcgttacagacatagtttaacctcacgagcatcgtctcatcatcgtcatcatcgtcatacaaacataagtagactccgaaccaaaacgctgtaaaacgatggagctaagctagtgcaagggatggag

SEQ ID NO: 81592 - DNA, 458 bp, Zea mays
  Clone ID: LIB3088-019-F8-F1A
ctctcagaaaagtttacaacattacaaccataaagatcagcactaacattatgagtttgttatcatgagtggcatgacatgcgtgccagacaaacaacaggtacattcatacatagcataacttacaacatgatacaagctacagagcacggtcaatcttacatatagaaaaaaaaagagagggaatccttcttaatgcagtttctgtgcggatgcgggatcaagcttgagccctcgtttgaggatttgcatggaaggccgactgcctattttgacccaccagcagatttaacgacagcgaagtagacaccgtttcctgaccaggctcccctatgcttagctttgacatgctcacaagttcatcagcattagttggattcttggaatgaactgcaacaggcttgacaatctcgtgcgtttcttgaggcagatcacctccatcttcctgatttggccag

SEQ ID NO: 81593 - DNA, 334 bp, Zea mays
  Clone ID: LIB3088-019-Q1-K1-A6
acgcccacgcgtccggactagttctagatcgctttcggcgtcgctgtgtgtgtttcgaggcacgcagtcatttggtgtgcgggccgtggctggcatgctctgagtctgagatgatgatgatgcctgatggcggcgtcgtgtcctgtagtcctcccctgccccctcgggcgcttctggcggcgagcagtgtgttgtgttgtgttgtgtgggtgcagcacggtagcatgctagccatgtgccctgctgtgttgagtcaccatccatctataataatcttatatctataccccaccttttgtgtaaaaaaaaataagtcttattaccacttagtctt

SEQ ID NO: 81594 - DNA, 400 bp, Zea mays
  Clone ID: LIB3088-019-Q1-K1-B5
tttggtttgtttttttgggtttgtttttttttttttgggttgtacccctaggtggtgggcggcatatatctggataatagccttgggacactatcatcatgcgttcgagggcaaaacagcatcgaccagtgacatgaaccggacacattaatagttaatacatacggtaggttgctagacacaaaggagcgaaccccttccttaccgaaacgcagtcactcacatagcatgatagcataaacagcctatacattgccacgcgtacctcatttccaggccgggtacgagttgtcctgccggttgttcctgaacgcgcagcacccgacggagtagacgacgaccaggaagatcaggaagaccatgttgacggtggcgatcttcttccaatcgttcttcaagt

SEQ ID NO: 81595 - DNA, 155 bp, Zea mays
  Clone ID: LIB3088-019-Q1-K1-C1.F2
aaaacccaaaataaggggggtttttttttttgcacccccccccccctaaggggggtacccaaattattttcccccccaaaggggggtggcccacaaaaaaaaaaaaaagggggggggggcccggggggggccaaaaaaaaggggaagggcccccc

SEQ ID NO: 81596 - DNA, 52 bp, Zea mays
  Clone ID: LIB3088-019-Q1-K1-C1.R1
agctgaacctgcaggacggtccgaattccgggtcgattacgcgtccgacacg

SEQ ID NO: 81597 - DNA, 352 bp, Zea mays
  unsure at all n locations
  Clone ID: LIB3088-020-Q1-K1-C11
ttctcgaccgactcttcctcccactcctccttctagcgctcccttttttttttttccctccgcagtgctacccnccggagttctctcttacgggggctggacagcatcatcatatcatcttcccttccttcatggattgatgcttgtctgccctctgcttctgctgcctcctatactccttcttcttatattgataaattccgaccaactgattctacacttctacaatttaaactactatctttctattctaaatatacagatatacatctttaactgttttgagcctataattctatcatgctattttatctttttcatatcataatttgtcaccctaattttttatttc

SEQ ID NO: 81598 - DNA, 228 bp, Zea mays
  Clone ID: LIB3088-021-Q1-K1-D6
catgaatgagaatgatggttacttacagtagcatctggtgcctcgttgggagcacaggggtttatagttcaggtgggaacggaagtatgctttctgatttacggcagagcgccgaatcgatggttatgtatgtctggttataaccaaccattgcatcactatttttcattgttaatattggtgttacgataaaaaaaaaaatgattaataaaatatcacttataaata

SEQ ID NO: 81599 - DNA, 384 bp, Zea mays
  Clone ID: LIB3088-021-Q1-K1-D7
cccacgcgtccgcccacgcgtccggcatttttctctggttactctacttgctcagatggtagtgttatgtggggccagaagaacaggacgatccagaggatttggttttgtttctttcaggaaccagcaggatgctcaaagtgcgataaatgacttgaatggtgtgttctctagttccatgtttctaacttatgttccattttgaagtcccgagtgtttcaaaaagtgctagcagctagacgtgcctagcaacctaggtggtgctcaggcgttgcttgacatttgtactttctatggacagtatgccatgttgaataaagtatttttggcatgacaaatataatttatatatatctttttgttacctatttgaatacgtatgaa

SEQ ID NO: 81600 - DNA, 107 bp, Zea mays
  Clone ID: LIB3088-021-Q1-K1-E8
cccacgcgtccgcagacgcgtgtgtgtaaatctggattatctatgttctgtggtgaacgactgtgttggactgggagttgagctcgtaatacaatagctcttaagat

SEQ ID NO: 81601 - DNA, 311 bp, Zea mays
  Clone ID: LIB3088-021-Q1-K1-F10
cggacgcgtgggcggacgcgtgggccgtcaactacctcttggatcacatgcacgagttggacaacgatgacgggctcggagggccaccgctatgagggcgctctcgatccctacatcatgcgaacgaaggctgtagggcagtagtaggaaaacgttttgggattcgtcccgtctgttcgctcactctacatattcgtttggctttgctgtttagtacagaatttctagatttacggacttactacttgatatcctgatatagaggtcacggccaagcttactttttttccccctaaaaaaaaaaaaaagaa

SEQ ID NO: 81602 - DNA, 345 bp, Zea mays
  Clone ID: LIB3088-021-Q1-K1-H3
atgcatccacacgttctcagcacctctcattgcttcactgtttccccaactgcaattaactagagtgtagtgtctacacaatcatggcgctggctattcatccaatcattaatgctcaagctccacttcttcgtgagcatgtcaccctttatcgacctcttatccttgccctattattctatgcttatctatatataccgatatctgctttattattacccaatactttttatacaatattttcacttaatgtactaaattattttgatttcgtttctattaacaatttttacaagtttattactctatatcaatcttgatgcttatcatttactatattaatat

SEQ ID NO: 81603 - DNA, 90 bp, Zea mays
  Clone ID: LIB3088-022-Q1-K1-E3
cccacgcgtccgaaaaaaaaaaaaaaagttttaaataaaaaaaaaaaaaaaaaaaaaaaagaaaagttaaaaaagaaaagggggaaagaa

SEQ ID NO: 81604 - DNA, 436 bp, Zea mays
  Clone ID: LIB3088-022-Q1-K1-F8
aagcttgtctctgccaccaaggagggtctgaagcttgatgagactgaggacgagaagaggaggaaggaggagctgaaggagaagtttgaggggctgtgcaaggtcatcaaggaggttctgggtgacaaagttgagaaggtggtggtgtctgatcgcgttgtggactcaccgtgctgccttgtgactggcgagtatggctggaccgccaacatggagaggatcatgaaggcacaggccctgagggactcgagcatggcgggctacatgtcgagcaaaaagacaatggagatcaacccagagaaccctatcatggatgagctccgcaagcgtgccgaggctgacaagaatgacaagtcagtcaaggatctcgtgatgctgctgttcgagactgctctcctgaccttcggcttcagcctggatgaccccaacaccttcg

SEQ ID NO: 81605 - DNA, 358 bp, Zea mays
  Clone ID: LIB3088-022-Q1-K1-G6
tcgcgcgcacgccgtcggctcgcagcacgccgtgatgctgacctgccgagaatccaggcttgcgtcgaccatcgggctgcggctgtggcaggccggagtcgtcgtgtatctagacatccggaggtggatctgatgagctgaaactgaagctgcacctgagccgctcagctgccgttgatagatgccctctgtttgctctgttttacgatccataggtgatgcatttattggctgaggggtcatttacaggtctgagacagagatgaggatgtgtaatactatcaatgtgacgacgggagttgtgaatatgctcatataagcagatcacattcgtgcgatgccaaatgacatggtggac

SEQ ID NO: 81606 - DNA, 300 bp, Zea mays
  unsure at all n locations
  Clone ID: LIB3088-023-Q1-K1-B8
cacggaacctgtggatgtggttccgtatcgtactgttggatctgtctgtcgtgtgctagtagtgtgcctgttgtcacctgtgcaaagggcggcgttaaatttgcgttttgcttcgtcttctggggaataaacagagttgacagtactcggctcaaaaagttcagatcgactcagttgttgttgtttttttttttttgccttgatttttcatctcgctcagctcgagtgagcaggttctgttgttaggttgcctgatcttggttatcaccggacgtaatgaaacaatggaacgcagtgcnc

SEQ ID NO: 81607 - DNA, 78 bp, Zea mays
  Clone ID: LIB3088-023-Q1-K1-D8
gtccaccaaggcggttcgcatagacagcgccagcaaccaaaaacgtgaagggttctaaaagaagggggggaggaaaaa

SEQ ID NO: 81608 - DNA, 336 bp, Zea mays
  Clone ID: LIB3088-024-Q1-K1-B10
cggacgcgtgggcggacgcgtgggcggacgcgtgggtggcggccgacgaggtggaaaggggcgtggaggaggctctgctgcacgaagtggagaggaagcagcagcagcagcttggagctgggagcgccgcccctggttttccaggcccgtcatcgcacgtgcaaaacgtgttttgacacgcgaagaaacatgaaccccgagcctcatttcttgattctttttttttaagaaccggatgcgcaaaacgagcatccgcgtctctggctctattgatttgtttttaatagaaatcggtcttgtttgtgtaaaaaaaaaatttaatatttattaataaaa

SEQ ID NO: 81609 - DNA, 225 bp, Zea mays
  Clone ID: LIB3088-024-Q1-K1-B3
acgcgtccgtaggtatgcgggtgaagcaaagcggcgcatgggattacgccttcctatcatgcattcagctgttgtttactcgatttggatatcatttaaatctgggtgaggttggaacataaatgcatcagtagtttctgtcttattatattggtacctctgttactgagttgatgtggtcctggctcctgagcttaaaaaataaatataaataattaataataa

SEQ ID NO: 81610 - DNA, 349 bp, Zea mays
  unsure at all n locations
  Clone ID: LIB3088-024-Q1-K1-E2
cagacgcgtgggcggacgcgtgggaaaatctgataattgaaacgtagtgagtgcatnagagtaggattcttaagcaccgggttgccttgccactgaacctatgattcaaatttcaaacagctggcactgaattcctgcaagcatgtacaacgcctacagaaaattgagctgaacacaacccacgcctacatcgggaagaatggcacaatggtccgtgacccctgtgcttcctagctttatttatcaagacttcataaattcataaatacgcatctcgctatatatggttgtgaaaccagcatacacaatcacagatgacacatgcctctcaagtcatcatatttattcg

SEQ ID NO: 81611 - DNA, 235 bp, Zea mays
  Clone ID: LIB3088-024-Q1-K1-H3
cccacgcgtccgagcctgcccccacttcgatggcagtttatttcggctgttgcacttgggctcgtctgctctagaggtcgggtctggtctggtctggtccgctaagctcattctctcaatgaggttttcgccgatttgcagtgtgtataattacatattcctgtaaacgaacaacgagaagaactactcttctatgtcctcagatataatgggtccagagtttaagatttgtacc

SEQ ID NO: 81612 - DNA, 235 bp, Zea mays
  Clone ID: LIB3088-024-Q1-K1-H8
cgacccactcgtccgcactattgtaaccctaatgacagtaaaacccaccgtgtgtctgctaccaaagaggaggggccttgtataggacatgcatacggtcacaaaccaccaaggtgccgtaaacatgcactgccattcaaatagtgtgagaagttgcgtttctaaaaaaaaaaaaaaaaaaaaaagataataaaacaaatataattaaaaataaaaaaaaaaaaaaaatataaaa

SEQ ID NO: 81613 - DNA, 276 bp, Zea mays
  Clone ID: LIB3088-025-Q1-K1-A12
cccacgcgtccgcggacgcgtgggccttgcccatttctcctcctacgtgactggcatctctgggtgttggcatggggctatcgttctatggttccagatgttcactgcactggtgttagcgtttagctacttcagtgcatcaatggttttgtgtgcaagtccttaatatgtaatacatttttgaggttttcatcatgcagaattaaataaatattataaagtaactatgaaaaaaaagaatttattgcatttcatttataaagaaagaagttaaaa

SEQ ID NO: 81614 - DNA, 288 bp, Zea mays
  Clone ID: LIB3088-025-Q1-K1-A8
acgcggacgcgtggggtttcgagggctagaaagtttcgccgtcgcatcctggactagggtggagtggggttaaagctggtggtgggaccaaactggcagatgtggcggagcagtgatcacgctttcctcttctgtagcccagctccagccttcagaaaaccttgttttctgccacgtgtgtctggagagctgccctgcgtatgaactttttttgtcacagtgttttgtgtgacacataacattctgtgtatgaacatgaggatgtctgttctaaaaaataaataaaaa

SEQ ID NO: 81615 - DNA, 245 bp, Zea mays
  Clone ID: LIB3088-025-Q1-K1-D1
aaaatgcataaatatgatgccctctggatatctgcactctatttcggtgattctgaatgtgatgtggcgtctccctatgtactgtgaggaaacatagttttgatgctaaagttgcctaggaatttggtacggtgaagtggcagtggacgttaacaatgttaagttttgagcatttaaattaaacctttgctctgataaaaaaatacgtaagtcatgcatgttaacaaacacattctatcatataa

SEQ ID NO: 81616 - DNA, 318 bp, Zea mays
  Clone ID: LIB3088-025-Q1-K1-D8
gtagagctattacctcagacaagtacatattgtcaaaaaatctgaatctgagtgggctcagtagaggacggagtcggtgttatgggcacctgctttggcgagactgactattatcagccatagcatcagttcaactcgaagtcaagaacatctttcccctcattcggtttaagtgtaatcggtgagggaccaattgtggcaacagcgagtaattattaattgttgagcatccatgaccgaactattaaagtttttgtaggctcaatgacatatttgaatagaaatttgtctttgatcaaaaaaaaatgactttgaaaa

SEQ ID NO: 81617 - DNA, 295 bp, Zea mays
  Clone ID: LIB3088-025-Q1-K1-G10
gcactcatacgcccactcgtcctcccactcgtcctaatagtattttgctaaaaaaaaaaaaaaaagaaaaaagtaaaatttaaaaaaaaaagaaggaatataaaaaaacacccactcttaactttctcaacttacatacacatccattctacatcactaccacattttatattttcacctaaattcaataacctgccctccaaataacatctatctatccatgaaaacccatccacaaccaaaccaaatcaccttccactacattccccttcttccaactagcttatcaccttat

SEQ ID NO: 81618 - DNA, 82 bp, Zea mays
  Clone ID: LIB3088-026-G1-R1A
tagagatgcatgagtcggtttccctgatctttgccctaaggtactatgtctcgttcaccaatgcgtcttcactgtccgaaca

SEQ ID NO: 81619 - DNA, 240 bp, Zea mays
  Clone ID: LIB3088-026-Q1-K1-B11
cccacgcgtccgcccacgcgtccggaaagagaaggcttgtcctctattgcgtctttttgggagttgtacctgtggctacgtgcccctatgactgtgagtacaagtacagaaactattgttaccttttgttgtaaaagtgtatatccagttcttttaagattaaatatgaaccagacttgtctaaaaaaaaaaaaaaaaaaaaaaaaataaaaaaaaaaaaaaaaaaaaaaaaaataaaaa

SEQ ID NO: 81620 - DNA, 305 bp, Zea mays
  Clone ID: LIB3088-026-Q1-K1-D2
tgcagatcatcagtgtcgatctcagtgtgatggcatcctgtccagtgaaaggactgctgggcagtaaacactactgccctgggttactctaaagacggacatgttcttaggttcatcgcagtttgtaatccagtacatgattaattgaagactagaaattcctagcgtaaagctctgctgagagcgtttgtcctggctgttcgcctgattgttttattgactgtagctcagagtgtctgaccttatctggaaaaatatggtgacggaaaatggtcttggagtcaaaaaaaaaaatattaaaaata

SEQ ID NO: 81621 - DNA, 369 bp, Zea mays
  Clone ID: LIB3088-026-Q1-K1-F12
gacgtcgtcaaggccatcgagaaggtgggcacccgcaacggctccacctccaaggtgggcaaggtcgctgactgcggacagctctcctagatctctctgatctggtctgttcggccgccctccctccgtcatcgtcgactccccctgcgtccgttcctttggatctgaataagatggtggtgatctgagtggtggtcttagtttatcatgtatcgctcgcagtttaatttagcggtttaggtgtggatctgtgaaccccatggcgcctctgcttgattcgtgtttcacctgttatgttctgagattcatgataatgctatgagaactgaaattcccgtttcatgcttcttaaaaacaaatttaataaaa

SEQ ID NO: 81622 - DNA, 386 bp, Zea mays
  Clone ID: LIB3088-027-Q1-K1-E11
acgcggacgcgtgggcggacgcgtgggcggacgcgtgggcggcagcggcctcctcgtcggaggggtctacagcgtactgtggggcaagagcaaggaccacctccaccaggagcatcaagacgacgaagagaagcagcagcagcagccgagcgcagcaggcggagacaaccagaagctgctgctgcacctgcacccatggacatctagaagccccatatgaacccaccaacctcacgctgcattctgagttcccaaaagactagactgcttctttagaaaattgttgtgagttgtgactctttgcttccgaagaacttctctatggtctctccgacgaacagttgcagttgcttgggtttggaccgactatttatcatgtgattgcg

SEQ ID NO: 81623 - DNA, 277 bp, Zea mays
  Clone ID: LIB3088-029-Q1-K1-C4
cggacgcgtgggtccacatcgtgatgttttatttttacttttgtcgtgctataacggatagcgctcctcgttggcgccactggcgggtggttctgcctctggtctggtgtgtttgtgtgtggtcacacttgccagctagcagaggcgcctgcttgtacctagattactgtttccattgtcgtcgtcatcggctaacattgtcataatgtcagtttgggtaatgttagattaaaaaaaaataaacaaataaaaaagaaataatacatacaaataaaaa

SEQ ID NO: 81624 - DNA, 338 bp, Zea mays
  Clone ID: LIB3088-029-Q1-K1-D10
tcggccacacgtacggtatccaaggctggatgtcacgtatcacaaaggttcagaccgagttcagagaccattgcacgactgaaggcgctacaaatggcgctagccgacatttaaagactacacattccatacaagattacaagactttagtgcagaacaatgcgagatcctccctaagatgcaaattaaagagtacaatcctataagatgctgctcaaagaaaattccataaaatgttggtcacacatacaattgaacattcttgtctactactaactatgtctcaccaaattactctgaattagttcgggtacgatctcgatattacaagaccacat

SEQ ID NO: 81625 - DNA, 291 bp, Zea mays
  Clone ID: LIB3088-029-Q1-K1-D12
atgtgatggtgtaggatcattagttcagctttctggtctactagccaagcttgcgcttgggggggaaactgaaggagcaccgtgaacttgttgtattacagatgataatagcttgagtcatgctgtgctatcatggtaacctatttcagctaataacgctgtcatgcttggcttaatttctactgacgcgatgtatctctgtaagatagtgcttactgaagaaacaactatcatgtttacccagagtggtagatctagctgttgtgcagcacccagagaaaggatatagac

SEQ ID NO: 81626 - DNA, 294 bp, Zea mays
  Clone ID: LIB3088-029-Q1-K1-E10
cacatacggaattggatcattttttcagctttctggtctacttgccaagttagcgcttgtgaggcaaactgcagaggaccgtgtactcgttgtattacagaccataataggctacgtgtcatactgtgctatcatggtaacctatgtcatgctataccgctgtcatgcttcgattaaattctacagacgtgataaatctctgtaagatagtgcttactgaagaaacaactatcatgtttacccagtgtggcagatctagctgttgtgctgcacccataaacatacaaacaacat

SEQ ID NO: 81627 - DNA, 379 bp, Zea mays
  Clone ID: LIB3088-029-Q1-K1-E3
agatataagattattatagatggatggtgacacaacacagcagggcacatggctagcctgctaccgtgctgcacccacacaacacaacacaacacactgctcgccgccagaagcgcccgagggggcaggggaggactacaggacacgacgccgccatcaggcatcatcatcatctcagactcagagcatgccagccatggcacgcaactaactgactgactgactcgaaacacacacagcgacgccgctatactttatttagcttataataattagctagcttcctccggccggcctgcaaggtggagcacctagctcacttgccgcagttgcaggggtcgcactggcagttgccgccgcacttgcacccgtcgttctc

SEQ ID NO: 81628 - DNA, 256 bp, Zea mays
  Clone ID: LIB3088-029-Q1-K1-F2
cccacgcgtccggcccaggctcccatcggccaaggactggtgtagtggtgtggagtgtggacgtgtgtgtgtaagtgtaactgtgtctgactctatatgaggttggcaggtgcaagttgctatccaccgtcctcgttggctcgttgagacttgagaatactttgaggttgcaatttcaaactgcactatgatgttgtaaactgggagttaagtattacgtgtactgttaaactcaaaaaataaaaatttataaaat

SEQ ID NO: 81629 - DNA, 265 bp, Zea mays
  unsure at all n locations
  Clone ID: LIB3088-030-Q1-K1-C5
acgcggacgcgtgggtttgcattgtaggctgtatcggttgtgttcgtgtgtgtttgcccgcgcgcttttttggccgatgcttgtgctntnaataactgcccctcctttgtttgtgatatgccaaaattttgaagtgagtacagtacaaccaaacatgttgatgatggaaaaacgaatggagaaaggggaaaaacaaacaaaaatggtttgggacggcagtgttccatggtnnaaaaaaaaattnaaaataaatattataatttat

SEQ ID NO: 81630 - DNA, 283 bp, Zea mays
  unsure at all n locations
  Clone ID: LIB3088-030-Q1-K1-D9
cttgtttcctttcattccggggcttgcgctatggtttgcttgttgtatttgctcgggttagtcggtatgtagtagggcttgggtgcntatcatgctgtatgctaccacaaagactttgttcacctgcactgcttgatatgccagccatggcatatgtgacgagtatttcattattttaaaaaaaaaaaaaaaaaaaaaaaaaaaaaaaaaaaaaaaaaaaaaaaaaaaaaaaaaaaaataaaaaataaatatataaataataaaaaaaaattaaaaaaaaata

SEQ ID NO: 81631 - DNA, 362 bp, Zea mays
  Clone ID: LIB3088-031-Q1-K1-C10
cacagcgtcaaatgctgcattcatagagcatgaggttcccaaatccagaacgaagttccagggtaaagaaatcaatgtgccggataaagcatgtcttgactgagagggctatagcggagcccgatccaaggagatcttcggaaatgaagcggatgataaatgccctgtgattcactcacaggcattctcccttgggacttttgatggtacttattagaaagatctgctgccttctgttgtatctttatcccataagaactgtgagaccaaatcttttcgatgcccatggtatggtagcaaaaattagactttaacttatccgatccaataattgtctgttgagctaaaaaaatgaaaaataa

SEQ ID NO: 81632 - DNA, 336 bp, Zea mays
  Clone ID: LIB3088-031-Q1-K1-C12
cccacgcgtccgggatccaaggctggatgtttcgtatcacaaaggagctgaccaagttctgggttcattgttggacttgaaacctgccgaatggggcttgccggcatttaaagagtatacattccatacaagattacaagagtctagtgaagaagaatgtgagatactccctaagatgcaaattaaagagtacaattctataagatgctgctcaaggaaaattccataaaatgttggtcaaacatacaattgaacattctagtcgactcttaactatgtctcaccaaattactctgaattagttcggttacgattccgatataaaaaaaaaataat

SEQ ID NO: 81633 - DNA, 146 bp, Zea mays
  Clone ID: LIB3088-031-Q1-K1-E1
gcgcaacaagtgtgtatcactagaattgtcttctaacccttgtgtacttgaattttattttacgattccagattttatttatgcgggtttgcactacacacctgcaataaatggaaatccattgggagttcagatgatagaagaag

SEQ ID NO: 81634 - DNA, 452 bp, Zea mays
  Clone ID: LIB3088-031-Q1-K1-E12
aaaaaaaaaaaaaaaaaaaaaaattaaaaataaaaaaaaaaaaaaaaaaaaaaaaaaaaaaggaaaaaaataaaacgggttctggagtatccaaagcttccctacccttccatgcaacttcatatctctcctatacagtcccctaaatctaattctctcaccctagtttttcaacgccttgactggaaaaaccctgcctttccccaacttaatctccttccactacatccccctttcaccacttgccttattatctaacaggcccactccaatctccctttccaacaatttcgcacccttaatttcgaatgggactccccctttattggttcattaatcccctctctttttattgtttacacccaacctttaccttttcactttctacctccctatctccctctccttattccatttttccctttctttttttccactttttctcaattttc

SEQ ID NO: 81635 - DNA, 209 bp, Zea mays
  Clone ID: LIB3088-031-Q1-K1-E2
gcgctgtcatgtaattcaagggaattgacctaagcacgatagagcattcatccgaaacaattgttcatttgtaataaacagttctatattccaaattaaaagtgtttatttgttataaaaaaaacaaaaaaaaaaaaaaaaaaaagtaaaaagaaaataaaaaaaaaaaaaaaaaaaaaaaaaggaaaaaaaaaaaaaaaaaataaaaa

SEQ ID NO: 81636 - DNA, 174 bp, Zea mays
  Clone ID: LIB3088-031-Q1-K1-F1
gcacgcgtacgtcgacgacagaagatgatctattgtgtgaactaacacctctttcgttacttggtcaagcggaacggcgacgacggcatgaggaaaatgcatgatcatataccaaacgagcataggtccaaagtcgacgagaacaaccctgcgatgaactaatccgtatctcca

SEQ ID NO: 81637 - DNA, 338 bp, Zea mays
  Clone ID: LIB3088-031-Q1-K1-G11
acgcggacgcgttggaaaaaaaaaaaaaaaaaaataaaaaaaaaaaaaaaaaaaaaagtaaaatgagaaaaaaaaaaaaaaatataagaaaaaaaaaaaaaaaaaaaaaaaaaaaaataaaaaaaaaaaaaaaaaaaaaaaagggcggcctttttaaagtttccaattttacttacccttgattccaaatttttatttcttttatatgttaacctaatttaaattaattggccttatttttaaaaacttttaattggaaaaaccctgggtttccccaacttaatcgctttttaaaaaatcccttttttccaatttttcttatttccaaaaaggccctt

SEQ ID NO: 81638 - DNA, 99 bp, Zea mays
  Clone ID: LIB3088-031-Q1-K1-G4
ctagcacacctaggtggggtagacagatgtttctaagcagtgattcatatattattgagaaatcatatagtactaatattggcgaaacataagacaaaa

SEQ ID NO: 81639 - DNA, 85 bp, Zea mays
  Clone ID: LIB3088-031-Q1-K1-G5
tcgcccacgcgtccgcggacgcgtgggaaaaaaaaaaaaaaaaaaaaaaaaataaaagaaaagggaaaaaaaaaaaaaagaaaaa

SEQ ID NO: 81640 - DNA, 125 bp, Zea mays
  Clone ID: LIB3088-032-Q1-K1-A1
cggacgcgtggggcagctgccgtctgcacgactgttgcagctatgaagctgtatgtaccttactgttggtgcactattttagttattgctaatcacaggggatacaatcggcatctgtgttgatt

SEQ ID NO: 81641 - DNA, 298 bp, Zea mays
  Clone ID: LIB3088-032-Q1-K1-A2
acgcgtccgcccacgcgtccgtgagacaccaacctctgtgccattcacgccaagcgcgtgggcatcatggccaaggacatccagcttggcgcgccgcatacgtggggagagggcctaagcatcgtatattctgtcatcagtgcccgatcagaagatgtagagatgtgctgggttctgtagtttgggttactgtcgaatcatcgagtagttggttgttcactgctgtaacttattatcatgatgcatatgaaatggcaatgaactatgttatcagttcttgtaaaaaaaaaaataaaaa

SEQ ID NO: 81642 - DNA, 277 bp, Zea mays
  Clone ID: LIB3088-032-Q1-K1-A6
tatcaacatccttagctctgcttctggagtccgctcaaggaaaattagcaggacttatatatgtgatctctgtttactgatgcggctggagcgtcatgtcaactgctcaccctccccctaacaaattaaactacacggatgagtggagcttcatgttgggatgatccatgcaccttttaagttttggacgtcgtactcaaatgtagcttgtgttggttgaacctattgtactttcttttcgatttaaattatatgatatttaaacattttgatgttt

SEQ ID NO: 81643 - DNA, 230 bp, Zea mays
  Clone ID: LIB3088-032-Q1-K1-F2
actgggtggtcattcaaacatcaactgagctatccagttgccaggttttaagtgtgttgtaatgcttcaatgtgtttcattttccaaagacctgagcttcgcttgtgatttgttccgagctgtacggtgtcgattttgtgtatataatataatataacgaaataaagggtacccagtatgagtatgatcattccgaaaaaaaaaaataaaaaaaaaaaaataaaataaaa

SEQ ID NO: 81644 - DNA, 314 bp, Zea mays
  Clone ID: LIB3088-032-Q1-K1-G7
cggacgcgtgcgcggacgcgtgggcgcgatcagtgcacatatgcaaacacataatctgacagagcctgtcaggcctgtgatcaccagcatcaatagagatgtcagtcgttgctagagatttggaccccatttgtcgagaattttctggtgttgcgccgtgcgatacacaacatacatgaaaatagaatattagctgatctctgggggtagtgacgaggaatgctgcgtgcaagtaggttttcgtgtatgctggattgtttgccgactgactgagcatgtgaagcctcaactcaacattcaaaataaaaaacaaa

SEQ ID NO: 81645 - DNA, 408 bp, Zea mays
  unsure at all n locations
  Clone ID: LIB3088-032-Q1-K1-H10
gcgtctcgatcgggttagtacctggcagtcatccatctggggaggtatctcatccttgggtnncccgtgaatgggtnncagcgatagtggaccgatnngtgccatcgtacatcttcatctggcttccatcaacttactatctgcactnatattgcagttggaatgctcatcangtgtctattttaatctggcttcctttttttccatcagctcagcagattnnagaatagatcccttctancctttttcaagctgaaagggtcagtanttgaaatatagaaaagtaggttatgctgaagtgatcaactgttggcatantgtcctcactnnttaatggggcaatatcttctttgtaacccggtttgcgaacccttattatgccttatatggaataccattgatgggttt

SEQ ID NO: 81646 - DNA, 381 bp, Zea mays
  Clone ID: LIB3088-032-Q1-K1-H3
ggagggctgatgtccatgcttggagttggaggcaacctgggaagcaatcctgatggttcgaaagcctgaaataccaaggatgagacgtagaagcacataatttaggttattttgcatgcctctgttatgattcttgcaatggaacatatacatgaatcttcaaatggccattgtgtaactatagtgcttgccaattggccattgtagtatttgctatgtacaagagtggttttggcatctagtcaatgttgtgcatagagctgagaactgcatagttacttgggttcagaaattatgcggaagcttgtaagttgtttcaaaaaaaaaaaaacacatgcatgcaacgaaatagataatttatagtgtaactctaaataaaaa

SEQ ID NO: 81647 - DNA, 295 bp, Zea mays
  Clone ID: LIB3088-033-Q1-K1-C1
gcgaacgactttggggaaaccgaagccagctgaaggaacttcctgaatcgaattgcccaggagccaacatacctagagctttggttttccttgtattgaagcaaggatatgtggaagcgctcggcacatagcctgctttggcactgcgagttgaaactaaatggaaaacggaggccacctgacgtaaatgagtgcgattgtaataaattgtatgtagttcatagctgggttggtatcagagttcaccatttcgtttttactgtagcgaatttcgttttttaaccaaagtttgact

SEQ ID NO: 81648 - DNA, 297 bp, Zea mays
  Clone ID: LIB3088-033-Q1-K1-G1
tattaggtcagtatctgtttgtggagactgggtgtttgatttatttagccgtttgtgactggttgtagctagcggtggtgcggtggtgatgttcttgaggcatgaataatgctacatgcatgtgatgtatccatgttttgtgtgtggtaaacctgttgtttgtataagctgtatgcatgtgggtctttaatttgttttgaaagcaggtttacgttattgaaaaatatatattatatatattttatatttcttatatatgtaatttattttttttattaataaaaagggcgggctttt

SEQ ID NO: 81649 - DNA, 290 bp, Zea mays
  Clone ID: LIB3088-033-Q1-K1-H6
agaagaggagggaggggaggaaatacgttaaaaaaaataaaacctgtacacgtgtctggccagatcgtgccgtcgatcgctcttcgttgttgatttttggttgtattgatcgatccgtatgtgtgcgtgcgtgtgtggcgttgctctttcttcttttgtgtagctgtgccctgccaccggccgacgtgcgtgcatgccatggtggcgggcagcgttttctaaggtcatatactgttgttgtgtttaagtaaaaaaaaaaatcattaatatatattttttaattaagaaaa

SEQ ID NO: 81650 - DNA, 73 bp, Zea mays
  Clone ID: LIB3088-034-Q1-K1-H12
tcccacgcgtccgaaaaaaaaaaaaattaatttaaaaaaaaaaaaaaaaaaaaaaaaagaagggttataaaaa

SEQ ID NO: 81651 - DNA, 101 bp, Zea mays
  Clone ID: LIB3088-035-Q1-K1-B6
ggactctccctgtaacggctcattaagctcttctgttgtgttggttactctcaacgtgacctttacactttccatctccctatctccctttcctttctctt

SEQ ID NO: 81652 - DNA, 290 bp, Zea mays
  Clone ID: LIB3088-035-Q1-K1-E2
gtcgcaccctagcagactacaacatccagaaggagagcactctccacctggtgctccgcctgcggggtggtcagtaagccatggttcatttaagctgctgctgtacctgggtatctgcgtcgtcgtcgtctaataaacatctgtggtttgtgtgtcatgaatcgtggttgtggcttcgttggtttaatggacctgttgtgtcctctgtgttgtacccaaaactcttctgcagcagtatggcttgaatccttgtgaagtttgatgtttgaacttaaaaaaaataaaataaa

SEQ ID NO: 81653 - DNA, 51 bp, Zea mays
  Clone ID: LIB3088-035-Q1-K1-F5
aaaaggagaaaaaaaaaaaaaaaaaaaaaaaaaataaaaaaaaaaaaaaaa

SEQ ID NO: 81654 - DNA, 152 bp, Zea mays
  Clone ID: LIB3088-035-Q1-K1-F7
acggacgcgtgggtaaggtttaaatgcagtcattttggagaactcccttgttcatgcttttgtcgggcttcttcaaaaggagagaggactttcttcatgacatgatggcatgtgaggcatcttccttttctccgcaacccttgtcatggcct

SEQ ID NO: 81655 - DNA, 278 bp, Zea mays
  Clone ID: LIB3088-035-Q1-K1-H7
agccgccacctctgattagcgtgagtacatgggtacgtcgactcaagaacgtaagctggctagttggttccatgtatgtatggagagggttaaatgtaattctttccaatggtccaaggcggatgctgcttccgaattagcaccatccgattcttttggaaaagatgtatactattacagtgaaaagtgaaaaaaagagagagttagctccttataaagctttctgagctctacacgtactacctccgttctcggaataaaaaatttttttatttaaa

SEQ ID NO: 81656 - DNA, 97 bp, Zea mays
  Clone ID: LIB3088-036-Q1-K1-E2
aatttccgggcggactcgttcgcggaggcgtgggaaaatttaccgagctatttagtgtaaataaaaaaaccaaaaaacaaaggaagggttttttaaa

SEQ ID NO: 81657 - DNA, 157 bp, Zea mays
  Clone ID: LIB3088-036-Q1-K1-F11
gcagctagagcacaaacaccaccagaacatccattattctccaacagaacctacaccaagtcagctttatatagcacaatggaagacccatactcacactcacactgacggctccacgactcaccatctctgcctgacatcacataacctcctcacg

SEQ ID NO: 81658 - DNA, 287 bp, Zea mays
  Clone ID: LIB3088-036-Q1-K1-F4
cgggcctgggtactaacacggggaggggatccattatccaggcccaggcccagcccagggaccactcccgctactagtatagtactaggcgcctccacctccacggcgttgggtgtttctcgtccgttaatagctcggtttgctttgcttgtgtttgtgtaagatatacattagttaagggcaataagcttgtactattatgagtggcggccgaggagtacagtacgttctcctctgtccgatcatgccatcattaacattaattaatgtgggagataaaaataaaa

SEQ ID NO: 81659 - DNA, 274 bp, Zea mays
  Clone ID: LIB3088-036-Q1-K1-G4
cccgacccacgcgtctcgctgtttctctgttggttctgagagatgtgttagttcacggatatggaggagcggtggtggattggtattgtaaagagggctgaaagaatggtccctctggttgggcgtgtcaccaaagagtggccctagaggcaaaccttacgtttgctcgttgcccttggtgtgtacccagatgtgtatcgatgacataggctggctgctgtatcatcatcagggttgacgctgaacaagagatattcaagcaaaaaaaaaatta

SEQ ID NO: 81660 - DNA, 339 bp, Zea mays
  unsure at all n locations
  Clone ID: LIB3088-037-Q1-K1-C10
agctattcattcgacgatttgctgaggtcaaggcgtgtgaaaaaaaaatcagctgcgattcgctaactgcaggtgccctctgccactatataatatataagactagggggagaagttttccttcccccggaaggcacggctgtacatattatattagggattggttggttgtttgtgcaggcatttttgtatgcatcatattcggcctgtatgggtcgaagctgtaaagtgtaaatgacacattcaaagatggaagttttgtttgaccaanntaaaattataatataaaaaaatataaaaataaataaaaaaaataaaatataaatattaataataaat

SEQ ID NO: 81661 - DNA, 265 bp, Zea mays
  Clone ID: LIB3088-037-Q1-K1-E4
tatacacccttcttatacttgaatataggttacttcattggactttcaccttaacactggggactgtattgttctgaggaagaatggatatataaaaagggcatgtctcttttaataaaccaatcttacttactcatgcatcctactccatagctctactatatttgtcacctatactcaattcactgaccatcgttttacaacatttagactggtaaaacccttactttacctaacttattcgccttacaacacattccctttt

SEQ ID NO: 81662 - DNA, 259 bp, Zea mays
  Clone ID: LIB3088-037-Q1-K1-F4
ttttactaggcatgggaacaggcacgttagagtgacgaggagaaaaaactatttttgtcatgcgtgggccggaataaattgagtcaggaattgcatggattttgggccaggacgatttgcaaattggttggattagagtgtggatggctgattggacattgtatcctatctgcattctgttcactcagttggctaattcacattccccaaaaaaaaataaaaaaaaaaaaaaaaaaaaaaaaaataaaaataataaaaa

SEQ ID NO: 81663 - DNA, 51 bp, Zea mays
  Clone ID: LIB3088-037-Q1-K1-H5
tttttttttgtttatttatttacaataaaagccatgtgaaaataagtaact

SEQ ID NO: 81664 - DNA, 209 bp, Zea mays
  Clone ID: LIB3088-038-Q1-K1-B7
ctcgtacaaatcattgtgatcacctcaccttttccagcaacaccgaaacccaggcttttagaacatattctactgtccagtcgcaaactcaaccataatgtctcggacaaacaacaacttattatactcttcggaagccaaccacgatcatctaaacccgccctatctctcatgctatttacaaatagcatatgcaatggtctgctccc

SEQ ID NO: 81665 - DNA, 132 bp, Zea mays
  Clone ID: LIB3088-038-Q1-K1-C2
aaagactgtgataacgatgctgttgcgaaactgaatacgatcgtagaaaattgccctatggccagctgtgtttacaaagaacatgcccgtaccgagcgccctgtccaacagatggtcaaccataatggcgaa

SEQ ID NO: 81666 - DNA, 305 bp, Zea mays
  Clone ID: LIB3088-039-Q1-K1-A2
tcccacgcttcctcttactcttggtaaaatttattttaaaaaaaaaaaaaaaaaaaaaaaaagaaaaatttaaaaaagtagggagacaaaaaaaacaaaaaaaacgggcccccccctctaaataatccaaccttactaacccttccattcaacatattaccttctctatattttcaccaaaattcaattcactacccctctttttacaacatcttaactgtataaaccctgtcttacccaaacttaatcccctttaataacaaccccctttcaccagcttgcttattaacaaatagccccacacc

SEQ ID NO: 81667 - DNA, 454 bp, Zea mays
  Clone ID: LIB3088-039-Q1-K1-C4
gtggcctatggctctggacttctaatcacttatgttgcgctgaacctgatggatgggcagtgacaacctgccgttgggtacgtcgttcccttcactcttggcaccttgatcgcgcttggatggaatagaggggagctgcttaacctgttggctaggtgtgagccattattagtttgcactcatattcatatgctccttcttcctactactttattctaacctcagtgttagtataaatttaataatggttttctatcttttatttattattttattttccttattgtttatattttttcttatattggggttgtgttatttttttttctctctttttatttattactttttctattaatttcttttatactttcttactttatctttttattttactttattttatcttcattattctatttttcattttcttttttttcttattttttttttt

SEQ ID NO: 81668 - DNA, 261 bp, Zea mays
  unsure at all n locations
  Clone ID: LIB3088-039-Q1-K1-F10
tctatcaaacattcactaactctttccttcattttattctnaaagacaagagaaaaactcacaagaatgacttttcttgaccggtggcaggtcaacaacttnttcatcaaccaaatgaagagcctttctaatccatctcatctcattccatttgcacataatggagcttgttctcctatgatagaccgtttctttgtgtgtttagggcaatacctcgcatttgctttgagaattataatcgtggttaaacctgacaatgac

SEQ ID NO: 81669 - DNA, 474 bp, Zea mays
  Clone ID: LIB3088-039-Q1-K1-G2
gacttgtcgaccgcgaccgatctcgtccggtcctctaatgccatgttccgtgtcttactttttcacttcaagaacacacgttagagaggtgttttcccttaggaaggggtcgctcaccaatgccaaaagtttccttgaggatgttatctcccactatcatgccatcccgttccgcatgtattgtggtggtttttttctcatatctcattcttattctttccactcaaatttttcattgactctattcttttctattcttttatattcattttatgtcccttttttaattaattttttatttcaatttcattagtaattttgactcatttttttattctctttttttgtgttgtatattcttattttttattgttttttttatctctttttcttttaattatttttttcatttttcatctcttattatttcttacttttatttttcttctattccattttaatatctaattcatt

SEQ ID NO: 81670 - DNA, 368 bp, Zea mays
  Clone ID: LIB3088-041-Q1-K1-C8
gcactcatgctgataatatacatatactacacttataaaatttttatatattataacaaattctcccaaaagattgattattaaaaagctctgccccatctcaatataaccattttaccacatgcccttcatctccccaagtttgacaaaccattcctaccacataaatccactaaacattttacaactccgaaatcgccacatattccaatataatacctaatcgctatacaccatgctttaatcatatcaccaccgtactcttctcaacatctcttctactttgtttatctatcttatcctttaactactaagattcttttttcccttaccaatttttaaaacaatccaactacccatttcccctt

SEQ ID NO: 81671 - DNA, 303 bp, Zea mays
  Clone ID: LIB3088-041-Q1-K1-D7
aaagaaaaaaaaaaaaaaaaaaaataaaaattaaaaaaaaaaaaaaaaaaaaaaaagaaaaagaaaatttaaaaaaaataacaacccctctaaaaaaatccaaaacttacaaacacatacatacaacaaaataaaatcttctatactgtcaccaaaatccaattcactgcccctctttttacaacttcataactttaaaaaccctcccttaacccaacttaatccccttacactacatccccctttcaccaactaacccattacctaacagaccctaaccaatctcccttccaaacattttcc

SEQ ID NO: 81672 - DNA, 64 bp, Zea mays
  Clone ID: LIB3088-041-Q1-K1-F7
aaaaaaaaaaaaacaaaaaaaaaataaagattaaaaaaaaaaaaaaaaacaaaaaagaaaagga

SEQ ID NO: 81673 - DNA, 86 bp, Zea mays
  Clone ID: LIB3088-042-Q1-K1-A8
aaaaaaaaaaaaaaaaaaaaaaaaaaaaaattataaaaaaaattaaaaaaaaaaaaaaaaaaagaaaaaatgggaaaaattaaaaa

SEQ ID NO: 81674 - DNA, 145 bp, Zea mays
  Clone ID: LIB3088-042-Q1-K1-C12
taaatatctgccttgcgttattgaagaatgtataagcctaaaaaaaaaaaaaaaaaaaaggaaaaataaaaaaaaaaaaaaaggccaaacaatataaaaaaataccaaaacataaaaacacatacatgcaacaacataacaaata

SEQ ID NO: 81675 - DNA, 306 bp, Zea mays
  Clone ID: LIB3088-042-Q1-K1-C2
cccacgcgtccgcccacgcgttcgcccactcttccgcggacgcgtgggtttgtaagcttggttttttgccgtgaaataaaagtagttgctgtacttgttgagctgttgtttggtagagtcatagtgacgatttattattactagcagtaccgagtctgtgatcatggccgagagattaagctcggattagcagtggccagcaagatgagctggcggccggcgctcttcagtcgcctgcgatgcaggcaacgcctgccggttgattagaagattttgtgcacgttgaaaaaacaagcgtctgctaat

SEQ ID NO: 81676 - DNA, 344 bp, Zea mays
  Clone ID: LIB3088-042-Q1-K1-C8
gcggcagcggcgaagggcattttgctgctgctgttcccgcagtctgtacacatgctaacacatgatccgtgtggtttgtgaagagaagctgctgccatgaacaatggacttcagccacaatattatgtggatgtcgtttcatgggctaccggcgatgctacaggccccgatcgaatgatgatcagcagatgggaactcgtagttccttgctgtctgcagcatctttctcatgtaccgctagcatgtgcgtgtttgtggttgggttgggttgtttggccgatttactgatcattggcgaatgaagtgatccatgtacatcattttgaagaattgcaaaataaaaa

SEQ ID NO: 81677 - DNA, 313 bp, Zea mays
  Clone ID: LIB3088-042-Q1-K1-D1
acgaacgccaaaaagagtttgatgtgaggactcaggaagtcgacagccttggacagttgggactgcaatatcaggagcagataaaaactcttgagataaataattacgcacttagagtgcatttgaagcaggctcagcagggcaattctatgcatggacgtttcccgcctgacgtcttctaatgtctgccatggctcaacagaataattatgcatggacgttcgttaatatttgatgctgtacagttggattttgaactaagcagtgtcaaataaaaaaaatcgaggtagtacctattaagaaaaaaataaaa

SEQ ID NO: 81678 - DNA, 203 bp, Zea mays
  Clone ID: LIB3088-042-Q1-K1-F11
gactaaattaatttgttatcatgtatacatcagggtaggcgtgatgctgtcttaagaaatgcaagtgataccaatttaagggcctgttattgaatagtgaggggttctagctccctcaatcctctttggaagtctggcttccaaagatttcaaattctaaaggcctaatatcactgtcggttatgctctaaaataaatgatat

SEQ ID NO: 81679 - DNA, 403 bp, Zea mays
  Clone ID: LIB3088-042-Q1-K1-F2
cccacgcgtccggaagcgtgtcaggtaccgtctggatggtgccaagatcggcaagatctggttggacccaaaggagaggaacaacaccgaatacaagctggacacctacactacggtctaccgcaggctgtgtgggaaagatgtggtctttgagtaccctatggccgaaaatgcataaatatgacgcccggatatccccattttattttgttgaatctggatgtttctttggggtctcaactagactgctccgtatgtacttcaaaaaccatagttttgatgccaaagttgttgcctaggaatttggtactcgggaattggtagcggacgtgaacaatgttaagttttgagcatttaaatttacctttgtcatgactaaaaaaaacccgcaatagtataagaa

SEQ ID NO: 81680 - DNA, 64 bp, Zea mays
  Clone ID: LIB3088-042-Q1-K1-G2
gttctgacaaatttgtctatcgatctttgattctctgctcttgttaaaagaaaaaaaaggaaaa

SEQ ID NO: 81681 - DNA, 273 bp, Zea mays
  Clone ID: LIB3088-042-Q1-K1-H9
cgctatttgttccaatctgaattgacgttactctctcttcgggaactctcaataagcacaccccctgtttcgagtgcaatgcatttgaaacggttaggtttctcataggaggtgtcatgctgccatactcctttgtactttcagattattgaacggagcatggcaaggtgtaatttagctcagctttcgcattggctcctggcctcctggggcgttatcataccgtgcggttggaatgaactgaggagcttcatgccaaaaaaaaagaacaaa

SEQ ID NO: 81682 - DNA, 126 bp, Zea mays
  unsure at all n locations
  Clone ID: LIB3088-043-Q1-K1-C1
cccacgcgtccgaaaaanaaaaaaaaaaaaaaaaaaaanaaaaaaaaaaaaaaaaaaaaaaggaaggggaaaaaaaaaaaaaaagggaaggaaaaaaaaggggagccaatctaaaaaacccaaaca

SEQ ID NO: 81683 - DNA, 336 bp, Zea mays
  unsure at all n locations
  Clone ID: LIB3088-043-Q1-K1-C3
canctcaacaaactctgcagcnagtcgtttggatcgtgtctnccgtcggtgaaaagagaaaccaacggcagaggagggcgcgccctggtttttacagcggctgcggctcccaacttcccaacaagtgagaaaaaaagaagaagaggcgaaacatactaagaccagccctagaaaactagctagccaagtactatgttgatctgtaggccgctttggcgattccgtcttccaaacctgtggagttgtgaatccttttgcagattaaagtaaagttcgttagccccnnnnaaaaannaaaaaaaaataataaaaaatataaataaaataaaaataaaa

SEQ ID NO: 81684 - DNA, 208 bp, Zea mays
  unsure at all n locations
  Clone ID: LIB3088-043-Q1-K1-G3
ccgtccgcnntccttttgacnaagnaaaatcattnntgtgtcttacaatnncaaaaaatacaaatcaagaaaatctcaactggcgtgtgtggnnngagccagaaagaaagggcggatgaaagttcaaaaaagggtngnntcgaagggtgcaacnnncaagtttctttccttaagcannagctgaaggggaacctccaatnnntttttg

SEQ ID NO: 81685 - DNA, 112 bp, Zea mays
  Clone ID: LIB3088-044-Q1-K1-E12
aaaaaaaaaaaaaaaaaaaaaattaaaaattttaaaaaaaaaaaaaaaaaaaaggaaaaaatggaaaattaaaaaagaaaaaaaaaaaaaaaaaaaaaaaaaaataaaaaat

SEQ ID NO: 81686 - DNA, 202 bp, Zea mays
  Clone ID: LIB3088-044-Q1-K1-E2
accacgcgtccgaccacgcgtccggacggcgttaaaagtttaactcttttggtttaggttgtgaaacccgtgctgtgcatgagttaccgtaacaggagggtttttttgttgttgttgggcacggtcagtgtccccgcaaatttgctttgactcgctgaatgtttttcggattcctagatctgcaatcagatacctagtcctg

SEQ ID NO: 81687 - DNA, 373 bp, Zea mays
  Clone ID: LIB3088-044-Q1-K1-F2
aagacatcgagggatggactgcaaggctgctcccgtccaggcagttcggatacatcgtcctgacgacttcggcaggcatcatggaccacgaggaggcccgccggaagagcgtcggaggcaaggttctaggtttcttctattgaagaagctgagaatctttggtatggcctgcctgcctgtcttactctctcagactagagtacctgttattttactttaatatgtctctctcagactagagagccttcttttacttgaatattggttactgcattggtctttcactttaaaatcggtgactgcattgatcgaattatctgagccggttcttcagatacaaaaaaaaagctgacatggacctttttcataaaaa

SEQ ID NO: 81688 - DNA, 304 bp, Zea mays
  Clone ID: LIB3088-044-Q1-K1-F8
atcgtctacccgccccgaaaaccctagttatatatatatatatatatatatatagacatatgctgattgtaacctaattagcctgcagccagttaagcagggactgcctactctgctaggaggacgtgtgtaatcatgtggcctgcgcaaacagtaatttgtgctggctgctgtgtattcatgctgctctgataatcgtgtcgtggtaataatatatcctatttattctaaaaaaaaaaaaataaaacaaatacagaaaactgaaagaaaaaaaaaaaaaggcacattaaaaaagaaattaaaa

SEQ ID NO: 81689 - DNA, 174 bp, Zea mays
  Clone ID: LIB3088-044-Q1-K1-H5
ctacaaatgcacttaaacgactccattacatttcatgccatcttaccatgcgtgcacagacaggtattcttttgcccttccgaatgcaaagtttgaaaagctcgtccacggatttgggtcttcttttgcccacccgaatgccaagtttcgaaaggctcggctaaaaaaaagaaa

SEQ ID NO: 81690 - DNA, 349 bp, Zea mays
  Clone ID: LIB3088-045-Q1-K1-A4
cggacgcgtgggcaggtggtcgctatgatccaattggcccacctgacgtcccagggtttgagccatctaggtttgttaggcgtccaaggcggcctccaggcgggagcacccacccagacctcgagttcttccagcaaggcccagacttctgagaatcgcgcagaggccggtcagagcctcgccctaccctcacgaaataacttcaaaatgctgagccctcgagctagatatcccgctcgcttggcgtgattgcaactgctgtatcgagtatagtcctagtgcgctttggctgtgaagatggatgtgaacatcggcctagtgtatctactcttaaattccagaaaataaa

SEQ ID NO: 81691 - DNA, 232 bp, Zea mays
  Clone ID: LIB3088-045-Q1-K1-D12
cccacgcgtccgctgcacccgccattatccatggtcgctcgctcctcgcctgcgtctcctggggttcgtctgaacgtcctcgcggcttcacgacggcgatgccgccgccgtcgatcctgtccgtctcgtgccggatttaatatttagatctatatgcgtgtttttctgcgttaaaaaaacaagaaagatatttcaactgaaaaaaaaaaaaaaaaaaaaaaagggcagacaa

SEQ ID NO: 81692 - DNA, 222 bp, Zea mays
  Clone ID: LIB3088-045-Q1-K1-E10
aaatagtcatgacaagaaaagacaatttggttacgacacgggcatgctcaaatagtcatgacgagaggagacgcttcagcagagagctggtgtattgaaaaggtgctcgcttatgtgagcctgtcctgggatgtagccttaactcctgtcttaatatgtggccctgcttgtgcttctcataccatgtctgctctttcagactgaaataactattaataagag

SEQ ID NO: 81693 - DNA, 251 bp, Zea mays
  Clone ID: LIB3088-046-Q1-K1-A7
cccacgcgtccgcccacgcgtccgtgtgtggcagatttgcatcgttttggtgtttcgtggctccatgtgtgagcatgctgtgtcctataacctggtttatgagatgagttgttaaacttgcttggcttgattggttttacctgtaagagctgatagttatataaaaaaaaaaaaaaaaaaaaaaataaaacaaacaatctacaggaaacaaaatgacacacacatgcattgccaattgacaaaacttgaat

SEQ ID NO: 81694 - DNA, 241 bp, Zea mays
  Clone ID: LIB3088-046-Q1-K1-B2
accactcgacccacgcgttcgtcaaccatacgataccttttacatcttttggacatcttactacaccatgtgcaattggctgaatctatatagcaattcacctgctcctatatcatattcaagattcatctcgtctataactacgtaattatcctattactgaattatactactttaatttgctcgacaaaactattgtgaagatggataaaaatgtgtagtgatggtggaaaaattaaaa

SEQ ID NO: 81695 - DNA, 286 bp, Zea mays
  Clone ID: LIB3088-046-Q1-K1-C2
atctaactatttattattatatgagatgggaggaactgatggagaataaatgctgctgtagatttgtagaagttcaaaaaaattgggtacccctgacaagtttgtagccaagggggtacatcatacagtttgagatgaggacactatgtatactgtttgagacgaggacattatgtatactactctagaaggctaccgaaaccaaattttgcatctgtttattaaaagcttgtacttctaaaaaaaaaaattagataaaaaaaggactggaataccaaaataaaaa

SEQ ID NO: 81696 - DNA, 225 bp, Zea mays
  Clone ID: LIB3088-046-Q1-K1-D9
aatgaccgacccgacccacgcctcctcggacagcctaccaaaaaaaaaaatccatctttaagaaatgccctctgaaaagcatcttgcgcaacttatctctcccaacattgtaatccctatcttactccgacacatccaacatgatatcgcactctaagttggtcaagcgttcctccaaagcaattagcatcctaagctatctacttatcaaaaaaaaaaacaaaa

SEQ ID NO: 81697 - DNA, 179 bp, Zea mays
  Clone ID: LIB3088-046-Q1-K1-F1
cggacgcgtgcgtccggctaggaatcggtctaacccagcaatccgatggaaacgaacaaggcctaggtggttatcttgaactgacgtgcatgtggcatcgcaatggcacatgaacataccgcgttccatgagtcagctaaccgcaatatgaacctaccacctgcggtatttgatccctg

SEQ ID NO: 81698 - DNA, 100 bp, Zea mays
  Clone ID: LIB3088-047-Q1-K1-B8
ccggggccgacgcacgcgtccgaaaaaaaaaaaaaaaaataaaaaatttaattttaaaaaaaaaaaaaaaaaaaaaaagagaaagttaaatttaaaaatg

SEQ ID NO: 81699 - DNA, 315 bp, Zea mays
  Clone ID: LIB3088-047-Q1-K1-F10
cccacgcgtccgcctactcgtggtggccttgtaaggactgctcctgtgcgtggagttcggcttgacctcgtgcaagtttcaacaggtaatattggctatggctaggttctatgaagactgagcatgtgccatttgggagaaaaagtacgttctacttgctagtatgcaagtcttattttgttgaaactgatgtcaattgtccttctgctacacatatcatcatttaggttatgtctgtagtctgtacttgtgtctgtatctggcctcatatataacatccttgttagatgtcatacagaagaatcatgttgcaat

SEQ ID NO: 81700 - DNA, 506 bp, Zea mays
  Clone ID: LIB3088-047-Q1-K1-F7.F2
gggttttgtttttttatttttttttttttttttttttggggtgtttttaaaaaaagaaataagaagataaaccacctcattggtttaacaaatacactagataatttctcggctccagcagagtacatccgggtaagatcaggatcctggtgggtgcgggagcacacaacccagagcgacccaggggatcaaccagctggtggagcaaacgggtctaaacaggacgacacgggagggtccttccgggccacatcagagcgacgggagcaaccagaacatggggacagcagaagttgcgatgaaggaccaggtgatgaacgccagcaccaccgagagcgcgtaccgggcggacgacaactgggggtacatcctgcagaagtggacgtccctctcgaacaggatgggcacgcccgcggacgccgacgcgggagcaaaccacagaattgcagggacccagtccccaacaacaaaaaggcttacaagcacaggggtgggaagatctcttt

SEQ ID NO: 81701 - DNA, 512 bp, Zea mays
  Clone ID: LIB3088-047-Q1-K1-F7.R2
caacttctttggagttttggccttgcttgtcttgatgtctactctttgaagactaaaagagatcttcacaaccctgtgcttgtaagcctttttgttgttggggactgggtcactgcaattctgtcgtttgctgccgcgtcggcgtccgcgggcgtgaccatcctgttcgagagggacgtgcacttctgcaggatgtacccgcagttgtcgtgcggccggtacgcgctctcggtggtgctggcgttcatcacctggtccttcatcgcaacttctgctgtctccatgttctggttgctgccgtcgctctgatgtggcacggaaggagcctgccgtgtcgtcctgtttagatccgtttgcttcagcagctggttgatgccctgggtcgctctgggttgggtgcttaagtaactatcaggatcctgatcttaaccggatgtactctgctggagacgagaattatctagtgtatttgtaaaacaatgaggtgggttatcttcttatttctttttttt

SEQ ID NO: 81702 - DNA, 93 bp, Zea mays
  Clone ID: LIB3088-049-Q1-K1-A2
gttgtgaacaagttaaatgcccaagacattttgtattgttccattccagctcaagaattcgaggctaagcattgcacaggaggaaaaataaaa

SEQ ID NO: 81703 - DNA, 52 bp, Zea mays
  Clone ID: LIB3088-049-Q1-K1-C3
aaagaaaaaaaaaaaaaaaaaaaaaaaaattaaaaaaaaaaaaaaaaaaaaa

SEQ ID NO: 81704 - DNA, 398 bp, Zea mays
  Clone ID: LIB3088-049-Q1-K1-H2
accacgcgtccggtggatgtaaaacatggtctattagtcccaactcttattatgttgtggttagctagagttgaaacctaatagaaaccacaagttaaggttcaagcacatgaatacctattttccatacacatatatttaaagttaaattttgtactcttatcattttaagtcttctttatcgtctttccacatattaaagttggtatttctctatatctctttccatagctgtcgcgctttaggatactactatgtacgagtgcttctagcactctgaaggtctcttaaccggctgtgaagtttttttttcaaaaaaaataatggactacacaaacatttattctaatgacttaaatattaagaatcaatctgagctaaaaaattaaaaaaaagaa

SEQ ID NO: 81705 - DNA, 175 bp, Zea mays
  Clone ID: LIB3088-050-Q1-K1-B3
ggtttctgtgctgtgtaacaatgtatcggtttattttctttaatggtgtgggaacattagtagaagatgaaacatttgactgcctttttccccactggatgtccactggatcacgtcgcaaaatatttttttttcatgattcatgcataattcctgctttccaaaaaaaaacaat

SEQ ID NO: 81706 - DNA, 176 bp, Zea mays
  Clone ID: LIB3088-050-Q1-K1-B4
ggtagctttcctgagtaacaatgtatcggtttatctactttaatggtacgtgaacattaggagaatatggaacattttactgcctttttcatccactgcatttccactgaatcacgtcacaaaatattttttcttcatgattcatgcataattcctgctttccaacctaaaactat

SEQ ID NO: 81707 - DNA, 160 bp, Zea mays
  Clone ID: LIB3088-050-Q1-K1-B7
taaatgctaatctacaaacttgtattatctattgtgcatctctagcttgggtatcacttgagaatgttcgcacttatgaccacactaacattcaactttaagcactccacttatacttttcttataaacattaacacttactatctacttaatacacttt

SEQ ID NO: 81708 - DNA, 362 bp, Zea mays
  unsure at all n locations
  Clone ID: LIB3088-050-Q1-K1-C2-F2A
gcgcccacgcgtccggtcgcccaccagctgccgttgccgttcggacccaggcatccgcaattcctgagcaacggcgatccggggacctcgggaggcctgtccctcgcgatcggcggcgcgggcggcgggcactggccttccgaggggggggacctgcagcagcagaggctgcacggcgcctgggccaacggcggcggcacgagctggccgcctccgccgcacccgcacccgcacncgccggcaccgagcaccggagntgcagcatcatcacgantccctccctacgttgttactacgacgcaaggcggggcaggctgggctcagaagaatgggtgncattcgctggccaggccaacctagta

SEQ ID NO: 81709 - DNA, 332 bp, Zea mays
  unsure at all n locations
  Clone ID: LIB3088-050-Q1-K1-C2-R2A
gtagaccaaacaaaaccaggtgggatgttgacaccccagtcagggtcatcatttattggggggcgccaatggggggtgaaagaaaaaaaaaggggccaagagggggtactgcctnacccgacgcctaatcgcctaccctaccaataactcaatgactcacttgtttttttcccgggaactcctcagggacaggccggccatccatcctcggatccatgttgcacccaatcaagaacacanagaagggagaagggaaggggggagggggagagagagaatggcatccggtaaattaaaacgtcgtcgtgcaggggttggagggggcgtcattt

SEQ ID NO: 81710 - DNA, 99 bp, Zea mays
  Clone ID: LIB3088-050-Q1-K1-E2
atgaagctttcctgcatccgtgtcgttagaggaaaaacaatgcgtaaattacaacaacgaggactactgaataattactgatataagctgaaatataaa

SEQ ID NO: 81711 - DNA, 312 bp, Zea mays
  Clone ID: LIB3088-050-Q1-K1-E4
cccacgcgtccggatcaatgagaagccacaggtgatccatgagtatgagtcaggtaagggggttaccaaccagctgatcattgtcaagctcgagagggccctgggaacgaagctgcgtggcaagaaataaccaggagcagcatacgtaagacaaggcagactgtctgcttattatatgctatgtttggtatctcaagtcatacggactgtttgcgttggtacaagagtgaattaactgtgtactactgaatgcttgctgcttgtcatatgagtatatgatctagctctaaaaagcgatacctttacaggggt

SEQ ID NO: 81712 - DNA, 352 bp, Zea mays
  Clone ID: LIB3088-050-Q1-K1-E7
ctcgatgacccgtacttctctgcgttgatgtcaattacattagttgacggagtgcttgtgtgtgttgaaagagctgaaacgcctgtgtgtcttaatctggaaccctcttctcccgttttacttgtccgtggaaacatttcatgttccagctggttgtatattccgaaacagaccatgttttagttcactcggttcttcgttgacttaagttatttatcaaatatttaagtatcgtacgtaagtttgaaacctggggggaagaactatgctggctttgttgtactgccaatttcaatttaggaaggatgaaattgaagttaaaaaacatctaaaaagctcatctacaagaaaa

SEQ ID NO: 81713 - DNA, 609 bp, Zea mays
  unsure at all n locations
  Clone ID: LIB3088-050-Q1-K1-G10-F2A
cccacgcgtccgcccacgcgtccgcccacgcgtccgcccaatctcccctacaccagaaaaattcccagttctttggtccgcgtcagagaggcggcggcgatgtctgggcgcggcaagggcggcaagggtctgggcaagggcggcgcgaagcgccaccggaaggtgctccgcgacaacatccagggcatcaccaagccggcgatccggaggctggctaggaggggtggcgtgaagcgcatctcggggctcatctacgaggagacccgcggcgtgctcaagatctttctcgagaacgtcatccgcgacaccgtcacctacaccgagcacgcgcgccgcaagaccgtgaccgccatggacgtcgtctacgcgctcaagcgccagggacgcaccctctacggcttcggaggctaggctaggcgcctcttcatagtcggggactggttaggggacatgtctctgtgtgatgctttctgtggtattattgctgcaatagccgtgtaatccatcgcttctgcaatgaagcgctcggaagcatgctacgtatgttgtgtctgtgggtgattgtatttctggtagtaacagtgattgttcctgaattntggataatac

SEQ ID NO: 81714 - DNA, 603 bp, Zea mays
  Clone ID: LIB3088-050-Q1-K1-G10-R2A
actgcgaatgagcttgtattatccaaaattcaggaacaatcactgttactaccagaaatacaatcacccacagacacaacatacgtagcatgcttccgagcgcttcattgcagaagcgatggattacacggctattgcagcaataataccacagaaagcatcacacagagacatgtcccctaaccagtccccgactatgaagaggcgcctagcctagcctccgaagccgtagagggtgcgtccctggcgcttgagcgcgtagacgacgtccatggcggtcacggtcttgcggcgcgcgtgctcggtgtaggtgacggtgtcgcggatgacgttctcgagaaagatcttgagcacgccgcgggtctcctcgtagatgagccccgagatgcgcttcacgccacccctcctagccagcctccggatcgccggcttggtgatgccctggatgttgtcgcggagcaccttccggtggcgcttcgcgccgcccttgcccagacccttgccgcccttgccgcgcccagacatcgccgccgcctctctgacgcggaccaaagaactgggaatttttctggtgtaggggagattgggcggacgcgtgggcgg

SEQ ID NO: 81715 - DNA, 119 bp, Zea mays
  Clone ID: LIB3088-050-Q1-K1-H12
aaaaaaaaaaaaaaaaaaataaaaaaaaaataaaaaaaaaaaaaaaaaaaaaaaaaaaaaagggaaaaaaaaaaaaaaaaaaagaaaaaaaaaaataaaaaaaaaaaaaaaaaaaaaaa

SEQ ID NO: 81716 - DNA, 78 bp, Zea mays
  Clone ID: LIB3088-058-Q1-K1-D6
tttatcaattgcccttacctgtttttagatttatctaatcgaatctcaaatgtcaacagtttaaataaaaaaggggaa

SEQ ID NO: 81717 - DNA, 652 bp, Zea mays
  unsure at all n locations
  Clone ID: LIB3088-029-Q1-K1-F5-M1
ctttgtattcaacacctacctatggtggatgactggacaaaagatgaagattttgcggaactccttcgaagataaaagcaaggatatcatagagatggaaacggaggaagcctatgagatggtacttaatgctgtgctgaaatgggtggagagcaacatgaaccccaggacatcaagaacattctttgtcactatgtcacccacccacacaaggagcagagactggggcgatgatactgacgggaactgctacaaccagacagcccccatcgaggacctgtcctactgggggccagacaccagcaagggcctgatgcgcgtgatcggagaagtgttcagcgcgtctaagtccaggatccccgtgggggttgtgaacatcacccagctctccgagtacaggaaggacgcgcacacccagatatacaagaagcagtggaacccgctgaccccggagcaggtcgcggaccctaagagctacgcggactgcacgcactggtgcctgccggggctccaggacacgtggaacgagctgctctactccaagctctttttcccctgagttaaaggtttgagttgcgaggtgcacggtgaanttggggtctctctctggcattggcacgctgcacaaatactagtagcttggcattggccc

SEQ ID NO: 81718 - DNA, 449 bp, Zea mays
  Clone ID: LIB3088-029-Q1-K1-F5-N1
gggggcaaatccaacccccacccccaggttttccaaaaaaagaaatggaaaaaaaaaaaaccctgccatgccaaacccaaaaaaaacatccatttttaaactggggggccaaagccaaacaaaataatattgggcaccgggccaatgccaaaaaaaaaccccaattttaccgggccccttggaaataaaacctttaactcaggggaaaaaaaacttggggaaaaaaaatttgttccacatgttctggaaccccgggaggcaccaaggggggaaagccgggtaatttttaaggccccccacccgccccggggtaaacgggttccacagcttttttgatatttgggggggcccccccttcccgtacccggaaagaggggggaagggaaaaacccccccggggatcccggaattaaaccccctaaaaactttttcgaaacccccaaaaagcc

SEQ ID NO: 81719 - DNA, 626 bp, Zea mays
  Clone ID: LIB3088-047-Q1-K1-D4-M1
ctgccaaccacttccaccgccaccgccgagcgcggtggcaccgacacgacacacgtagctgcagacctgcagtgccagcacggctgccaatccctgctggcgctgttcccggctccgagatcatttggactcggcactcggcagggatggggatggggacggaatggccgccgacgcctgcgcagcagaggaaagcggtggtgagcgccgggtcggcgctgaagctggtactgttcgtgattctcgcgggcctcgcactgcggctgctggtggggcccccagcctacctcctgccgcccaccgccgcgccagagggggccgctcgtcttttcgcggtgccggagagggaaagaaccgccggcggcggcggcggcgggataccttccgtcgaaacggatgatgcggtttttactttgaccgattcagaacctctaacagctttaggcaagaaggaaggttccacaaaaccagaagaaagttgtgatcttttccatggcgagtgggttcccaattcatcaggaccagcttatactaatgcaagctgccgcttcattgagtctcctcagaactgtatgacaaatggaagacctgacacagattatctcaattggagatggaagccatat

SEQ ID NO: 81720 - DNA, 451 bp, Zea mays
  Clone ID: LIB3088-047-Q1-K1-D4-N1
agggaagaaaaagaaacttggaacaatactgggggtcaaaacaaaagccctgcctaggggccccccccaccccccgaaaaggcttcagccctttgcccccattttcataattacctcggtccacccataaataggcccaggcaagcccccgggggggcaggcattttggactttggctggcccccccttttcggaagggggggatgctctataaggccctggatgaccatcaggcctggggagagagagcccaaatgttttgagcagttttaaacgggcccccccgataggcccccggttgggaaacttttttttttcaatcccccacaaactattggcccattctttggcaccggccccccctggtttgaaaggggcccccctgttgcaagtccccccgctgaaccactcgccgttttcaaaaggcgagggagccccccttttgtaaaaa

SEQ ID NO: 81721 - DNA, 452 bp, Zea mays
  Clone ID: LIB3088-005-C12-F1B
ggcatgacaacgatttataaagttccaagcttcgcacacaacacaacacacacgaggtcttagcttcaatacatagtctcgcgtcctgcagggtgaatccctgctgtgcatcaactttattttgggtcatcagagcatttcatatccatccagatcgaccatgctcattcgggtccaccaggtcctcgttgttcagctgatccatgtaggcttgatgatggtacccgaactgcagggaaggatcgttgtccaggtgctgaaggagcccctgataaggatcaagaacattcccacttgcgccactgtgcccaccttcctcccaggagacacggagcgcgttctctggccttgtttcttgcagctgcttccttaggtctttattgagatccagcaattcttgttccttgcttttgaggtcaaagagctgatcaagtagcattcggacgcgtggg

SEQ ID NO: 81722 - DNA, 452 bp, Zea mays
  Clone ID: LIB3088-005-C12-F2B
ggcatgacaacgatttataaagttccaagcttcgcacacaacacaacacacacgaggtcttagcttcaatacatagtctcgcgtcctgcagggtgaatccctgctgtgcatcaactttattttgggtcatcagagcatttcatatccatccagatcgaccatgctcattcgggtccaccaggtccttgttgttcagctgatccatgtaggcttgatgatggtacccgaactgcagggaaggatcgttgtccaggtgctgaaggagcccctgataaggatcaagaacattcccacttgcgccactgtgcccaccttcctcccaggagacacggagcgcgttctctggccttgtttcttgcagctgcttccttaggtctttattgagatccagcaattcttgttccttgcttttgaggtcaaagagctgatcaagtagcattcggacgcgtggg

SEQ ID NO: 81723 - DNA, 127 bp, Zea mays
  Clone ID: LIB3088-005-C12-F3A
gcgtgtaccgcaatcttaatgcgcctcgcagcacatcctcctgatgtgacagctggtgaaatagcaaggaggccgcgtacctgatcgcctcttccacaacagttgagctgcctgaatggctaaagga

SEQ ID NO: 81724 - DNA, 467 bp, Zea mays
  Clone ID: LIB3088-005-C12-R2B
cccacgcgtccgaatgctacttgatcagctctttgacctcaaaagcaaggaacaagaattgctggatctcaataaagacctaaggaagcagctgcaatgaaacaaggccagagaacgcgctccgagtctactgggaggaaggtgggcacagtggcgcaagtgggaatgttcttgatccttatcaggggctccttcagcacctggacaacgatccttccctgcagttagggtaccatcattaagcctacatggatcatctgtacaacgaggacctgctggacccgaatgagcatgggcgatctggatggatatgaaatgctctgatgacccaaaataaagttgatgcacagcagggattcaccctgcaggacgcgagactatgtattgaaactaagaccttctgtgtgatgagtagtgtgcgaatcttgcaactttatacaatcggtgaaatgccaaataaaaaacaa

SEQ ID NO: 81725 - DNA, 535 bp, Zea mays
  Clone ID: LIB3088-002-Q1-K1-C11.F2
gcagcctaggccgaggtgaacttggtgacggccttggtgccctcggagacggcgtgcttggcgagctccccgggaaggacgaggcgcacggaggtctggatctcacgggaggtgatggtaggcttcttgttatagcgcgcgagcttggcggcctcagcagcgagcttctcgaagatatcgttaatgaaggagttcatgatggacatggccttggaggagatgccaatgtccgggtgcacctgcttcagcaccttgaagatgtagatcttgtaggtctccacgctcttcttgcccttcttcttgcccctcttgccctcgccgccttccttggcagcggacttgccagcggggacccgcttctccgccttcggcttcttcccggcgggcgccttctcggccgcgggctccttctccgccggcttcttcgccgcgggtttcttctcggccttgggcgccatcgatgcggggcgagtttgggttttggttgcgaaggggggatcggatgggaagaaatcgaggaagatcgtagcctggg

SEQ ID NO: 81726 - DNA, 534 bp, Zea mays
  Clone ID: LIB3088-002-Q1-K1-C11.R2
cccagcgtccgatctcctcgcatttcttcccatccgatccccccttcgcaaccaaaaccccaactcgccccgcatcgatggcgcccaagccgagaagaaacccgcggcgaagaagccggcggaggaggagcccgcggccgagaaggcgcccgccgggaagaagccgaaggcggagaagcgggtccccgctggcaagtccgctgccaaggaaggcggcgagggcaagaggggcaagaagaagggcaagaagagcgtggagacctacaagatctacatcttcaaggtgctgaagcaggtgcacccggacattggcatctcctccaaggccatgtccatcatgaactccttcattaacgatatcttcgagaagctcgctgctgaggccgccaagctcgcgcgctataacaagaagcctaccatcacctcccgtgagatccagacctccgtgcgcctcgtccttcccggggagctcgccaagcacgccgtctccgagggcaccaaggccgtcaccaagttcacctcggccttagctgc

SEQ ID NO: 81727 - DNA, 523 bp, Zea mays
  Clone ID: LIB3088-004-Q1-K1-E10.F2
aaccatagcaatgcattaccaccatgactaaattcataacacaggcaaaagccactgcaccacttacacacaccagccaaccaccactactaccatgagaagcggcacatcacagtgcttgcttgagaagcagacaacaacgacgcctactacaagggggctaagacgaggtgaacttggtgacggccttggtaccctccgagacggcgtgcttggcgagctcgccggggaggacgaggcggacggaggtctggatctcgcgggaggtgatggtgggcttcttgttgtaccgggcgagcttggcggcctccgcggcgagcttctcgaagatgtcgttgatgaaggagttcatgatggacatggccttggaggagatgccgatgtcggggtgcacctgcttcaggaccttgaagatgtagatcttgtaggtctccacgctcttcttcgccttcttcctaccctttttgtcgccgccctccttgccggcggacttgcccgcaagtagccgcttctccgccttggg

SEQ ID NO: 81728 - DNA, 612 bp, Zea mays
  unsure at all n locations
  Clone ID: LIB3088-004-Q1-K1-E10.R2
cgcaacttcacagcgtatcatcgttttccatcgctcctactcctatcatccagaaaatctgagcggtattgatggcgcccaaggcggagaagaagccggcggcgaagaaggtggcggaggaggagccctcggagaaggcggctccggcggagaaggcccccgcggggaagaagcccaaggcggagaagcggctacctgcgggcaagtccgccggcaaggagggcggcgacaagaagggtaggaagaaggcgaagaagagcgtggagacctacaagatctacatcttcaaggtcctgaagcaggtgcaccccgacatcggcatctcctccaaggccatgtccatcatgaactccttcatcaacgacatcttcgagaagctcgccgcggaggccgccaagctcgcccggtacaacaagaagcccaccatcacctcccgcgagatccagacctccgtccgcctcgtcctccccggcgagctcgccaagcacgccgtctcggnagggtaccaagggccgtcaccaagttcaacctcgtcttagcccccttgtagtaggcgtcgtttgttgtctgcttctcagcaagcctgttgatgtgccgcttctatggtagtag

SEQ ID NO: 81729 - DNA, 529 bp, Zea mays
  Clone ID: LIB3088-011-Q1-K1-D5.F2
caaccgtcccaaacaaatttattgataattaatactaaacagtagggggcttaaaaccataaaaaaacagggtccagaatgtaaccacagataatgcaaacacggtgcaacacccagcgatccctgcacttgtgtttgccatagcaaaagccagctcaagccagatggatgtctttgtagcaatccttgatacactttttttttcgatttaggttttgagatacagtattccaaggcagggaaagttacttggggccaacatccttcagcgcgcaaatctgctcctcccccatagcaaactggacagtcacaacaagatccttgccgttttcaaacccttccttgatctgggccacaagagtctcatcagttgggagtctaaaatcatcctttagtgttgccatctgaagtaagaaggctcacaaatccatcctctgttatatcaatcagctggtactcagtacggttcacatgcggaattcacagtttgtgtgacgaaggaacaatatcttcgagctttttcccgttg

SEQ ID NO: 81730 - DNA, 660 bp, Zea mays
  unsure at all n locations
  Clone ID: LIB3088-011-Q1-K1-D5.R2
ccgggnncnaccccacgcgtccgcccacgcgnnccgcccacgcgccccggagccgcagcctctctccatctccctgctcctccgcctccttcttgatccagccaagccaggnatcgccatgtcggactcggaggagcaccacttcgaatcgaaggccgacgccggagcgtccaagacctacccgcagcaggctggcaccgtgcgtaagaacggcttcatcgtcatcaagaaccgcccctgcaaggttgtggaggtttctacctcaaagactggtaagcatggccatgccaaatgccactttgttgccatagacatattcaacgggaaaaagctcgaagatattgttccttcgtcacacaactgtgatattccgcatgtgaaccgtactgagtaccagctgattgatatatcagaggatggatttgtgagccttcttacttcagatggcaacactaaggatgatcttagactcccaactgatgagactcttgtggcccagatcaaggaagggttcgaaagcggcaaggatcttgttgtgactgtccagtctgctatgggggaggagcagatctgcgcgctgaaagatgttggccccaagtaacttccctgccttggaatactggatctcaaaacctaaatcgaaaaagaagtgtatcaagg

SEQ ID NO: 81731 - DNA, 360 bp, Zea mays
  Clone ID: LIB3088-011-Q1-K1-G7.F2
gcaggtagtatgcttgccagcatctcttcattgcagaaaaaaaaatggattacatccaggaacgcagcaacactacgacccacagcgacagagacgtttcaccctaagcattccccagctacgaagaggcgcctagcctccgaagccgtagagggtgcggccctggcgcttgagcgcgtagacgacatccatggcggtgacggtcttgcggcgcgcgtgctcggtgtaggtgacggcgtcgcgtatgacgttctcgaggaagatcttgagcacgccgcgggtctcctcgtagatgagccccgagatgcgcttcacgccgcccctccgagccagcctccggatcgccggcttggtgatgcc

SEQ ID NO: 81732 - DNA, 382 bp, Zea mays
  unsure at all n locations
  Clone ID: LIB3088-011-Q1-K1-G7.R2
tccgggtcgaccccgcgtccgggcatcaccaagccggcgatccggaggctggctcggaggggcggcgtgaagcgcatctcggggctcatctacgaggagacccgcggcgtgctcaagatcttcctcgagaacgtcatacgcgacgccgtcacctacaccgagcacgcgcgccgcaagaccgtcaccgccatggatgtcgtctacgcgctcaagcgccagggccgcaccctctacggcttcggaggctaggcgcctcttcgtagctggggaatgcttagggtgatacgtctctgtcgctgtgggtcgtagtgttgctgcgttcctggatgtaatccatttttttttctgcaatgaagagatgctggcaagcatactancctgc

SEQ ID NO: 81733 - DNA, 306 bp, Zea mays
  unsure at all n locations
  Clone ID: LIB3088-042-Q1-K1-C7.R2
tttttgttgttcccttgtctttttgttttgtttgtgtgtgttttggtttntgtttttttgcttttggtttgttttgttattttgtttcctggttggtgtntgtggntgntgttggggggttcttgtctgtcttttttcgtttggttggtttgcggtggtgggttggtgtntgttgtgttgttgtttttgttttttgtgtctatgggttgtgtctgtggtggggttatggttgctgctggctgtgttggttttttgtggttgttctggttcgtcgcangcgtttggttggatttgccttgtttgtgt

SEQ ID NO: 81734 - DNA, 676 bp, Zea mays
  unsure at all n locations
  Clone ID: LIB3088-043-Q1-K1-C2.F2
gccgtggttttttgttttttttggtttttttgttgggggggtgtttttttttttgtttttttttttttgttttttggttttttgtggtgggggggtttgnttggnnnntnnggtnttntnnggggggggggtttttttttnnnttnnnntnttttttttggtgggggggggggggggtnntntnnnnnnnngnnntnnnntnnngnnnnngnngngggggggggggnggggggggggggggggggggggggnngnnnnggnnnggnnnnnnnnnggnngggggggggnnnnggggggnnngggggggggggggngnnnnnngggggggggggggggggggtggggggggtggtggggggggggggggggtggggggggggggggggggggggggntggnggggggnggggtggggggggggggggggggggtgggggggngggnnggggggggggggggggggggggggggggtgnngngntnggggggggggggggggggggggnggggggggggggngnnnntnntttttttgtggnggtgggtgggggggggggggggnggggggggggggggggggggggggggggggggggggggggggggaggggggggggggggggggggggggggggggnggggggggggtgtgggggggggggggggggnggggggg

SEQ ID NO: 81735 - DNA, 249 bp, Zea mays
  unsure at all n locations
  Clone ID: LIB3088-043-Q1-K1-C2.R2
tgcgctgtgtcccgggtgctgtgtgttcgtgtttttgtgggttttgtggctgttgccgggtttttttttttttttttttgcncgctngtcctttgtgggttgttggggggttgntgttngttttgtgttgttgtttgttgttgctggtttttttgtcggttttgttgtgcttttgttggtgctgggttttgttttggtgttggggtttgtttgtttgtnggtggtggntgtttgttgttgttttttttg

SEQ ID NO: 81736 - DNA, 594 bp, Zea mays
  Clone ID: LIB3088-049-Q1-K1-A5.F2
catcggtaattgcaacgtttttttattcacaacaataaaatattattttctgcaagagggaccaaaagaattaaataaaagtaccctccgaggtgacgttgcttgttacagaggacgtgccaagtcatttcgggacaacaagtttgcacaacggaaagctgttcaaaccatttcagacaggatatgccggtatctgacgaagtccgatgtggccttgaagctcggagtgaactcgcagaagaagctcagcactgcagccaggttgtgggcgctgttcttcgccagggctttctccagaaatagggcaggctgcacggtgatcaccttgtattttctggcatagcgcagggcctccaagtagtacccatcttgcagcatcgcagtcacgtagtcgtgatgcaggcctcgctccctcagcatgtccatgcccagcttcctcgttggcgggtgctgcagacccagctccataagttgcattgccagttctttacacggctcaagaatcttgtttgacacaaacaatgctatttcagcgtaacggttgctacgagctagtagtgtcgccgtcatcacataaaggttgtgaggagcctt

SEQ ID NO: 81737 - DNA, 614 bp, Zea mays
  Clone ID: LIB3088-049-Q1-K1-A5.R2
cgcttttcttatgcaattggcattgtcatttttattaagcaatcagatgcttggaatcagctgtacgaatttgtaccacaaagggatagccttagtttactttcaaacctggaaccgtggcaatttctccaattgagatgttccagtctgtctttacacttgttgaagatgaaatgatgggtgatcctgcatatcttattgctgtcatcatagagtttctacggagtgtctcaaaggctgggcttaaggctcctcacaacctttatgtgatgacggcgacactactagctcgtagcaaccgttacgctgaaatagcattgtttgtgtcaaacaagattcttgagccgtgtaaagaactggcaatgcaacttatggagctgggtctgcagcacccgccaacgaggaagctgggcatggacatgctgagggagcgaggcctgcatcacgactacgtgactgcgatgctgcaagatgggtactacttggaggccctgcgctatgccagaaatacaaggtgatcaccgtgcagcctgccctatttctggagaaagccctggcgaagaacagcgcccacaacctggctgcagtgctgagcttcttctgcgagttcactc

SEQ ID NO: 81738 - DNA, 309 bp, Zea mays
  Clone ID: LIB3114-007-P1-K1-A12
cgcgtccgggaggagcaagtagggtggcgatgctgcacaaggcacaacactggcgatatctgaggcaaggacagttggagaaggtgcaaaagatggactcctagttaccgtgggtgaagccagctaattaatgttttagagaaataattctctcttggagactactactactgttctacctcagcatcaccggtgctggtgcgtgtgtaacgtggtcactgggggtatcatcactaccctaccctaagccctatcagaacatatgcaccccttggagatttgtgccgtctaaatgaatataggtggttc

SEQ ID NO: 81739 - DNA, 68 bp, Zea mays
  Clone ID: LIB3114-007-P1-K1-A2
aaataataaaatttaaaataaaaaaaaaaataaaaaaaaaaaaaaataaataaatgggggtaaggggg

SEQ ID NO: 81740 - DNA, 67 bp, Zea mays
  unsure at all n locations
  Clone ID: LIB3114-007-P1-K1-A3
aatatataataacaaatataaattattttattttaaattatattttaatataaatttattaatanat

SEQ ID NO: 81741 - DNA, 80 bp, Zea mays
  Clone ID: LIB3114-007-P1-K1-A4
aaaaaaaatattataaaaaaatataaaaaaattaaaattaaaaataaattaataaaatgataatgggggagaatattaat

SEQ ID NO: 81742 - DNA, 57 bp, Zea mays
  Clone ID: LIB3114-007-P1-K1-A5
aaaaaaaaaaaaaaaaaaaaaaataaaaaaaaaaaaaaaaaaaaaaaatatattaaa

SEQ ID NO: 81743 - DNA, 285 bp, Zea mays
  Clone ID: LIB3114-007-P1-K1-B4
ctaaaaaaaaaaattataaaaaaaactataaaaaaaaaaaaaaaaatacaaactaaaaaataaagggaaaatgggtaaaaataaaaaaagaaataaattaaaataaaaaaatcaaataaaaaacaaaatgggggggatggttttaaagtatcaatgctttataacaatgtgtatgggaataacataaattttttttaatgggtaaccttaatttaaattaagtgggccggcatgtttaaaattgtcttaatgggaaaaactatggtttatcaaaacataatgact

SEQ ID NO: 81744 - DNA, 52 bp, Zea mays
  Clone ID: LIB3114-007-P1-K1-B7
aaaaaaaaaaaaaaaaaaaacaaaaaaaaacacaaaaaaaaaacaaaaacaa

SEQ ID NO: 81745 - DNA, 353 bp, Zea mays
  Clone ID: LIB3114-007-P1-K1-B9
aggagctcctccggaaagaatgagaatgagacgacggcgggtgccgagaacgatggggctgggcagtaccaggtacaagcaggcgccactcttgatgcgcctgttggtggcagtattcccattcctgggatcatggttcagtgtgctctgaactgtgctccttcgttccaaattataagacgttttggttgtcggctttctctagattcatagctttttgctatgtacttggatatacactatgtctacaaacgttataaaagcaatgtgtatagaaatgtcataatttggaaaaaaaaaaaaaaaaaaaaaaaaaaaaaaaaaaaaaaaaaaaaaaaaaaaaataaataaaa

SEQ ID NO: 81746 - DNA, 253 bp, Zea mays
  Clone ID: LIB3114-007-P1-K1-C1
aaaaaaaaaaaaaaaataaaaaaaaaaaaaaaaaaaaaaaaaaaaaaaaaaaaaataaaaaaaagggaaaatggggaaaaataaaaaaagggaaatgaaaaataaataataataaatataatattataaagaaaatattttttataaatgtaataaatattataatttataatttacttttaaatttttacttttaatttaatttattttatattataattaattatatatttttttatatttaaatatttat

SEQ ID NO: 81747 - DNA, 177 bp, Zea mays
  Clone ID: LIB3114-007-P1-K1-C12
aaaaaaaaaaaaaaaaaaaaaaaaaaaaaaaaaaaaaaaaaaaaaaaaaaaaaaaagggaaaaaggggaaaaaaaaataaataaaaaatggggcggcctttttagaagtttccaggcttatttccgcgttcttgcgacgccttaccttttttttcggggcccctaatttcaattgcg

SEQ ID NO: 81748 - DNA, 106 bp, Zea mays
  Clone ID: LIB3114-007-P1-K1-C2
actttgggtactatcaggacttgtaataattacaattcttcttatgttgtaaaacttgagctttgtaaatgtaaaatatgttttgtaaagtcttccgctttatctc

SEQ ID NO: 81749 - DNA, 268 bp, Zea mays
  Clone ID: LIB3114-007-P1-K1-C4
agaagctctgccaacttttagagcagaatccaaaacttatgcaaatgctccaggatcgcattggccagttgtagtcgcactggaggtgctattgtgaaagtgaaatctgatgctggtcgatcgctaggttcctagagtatggtgttgttttgttttcggctatggctgtagctagatgaaagcaactgccagcttgctagtcgccgaaatgtattcctatgtacattatatgtaactttgttctgtaatgtgaaaatttgtaatgttt

SEQ ID NO: 81750 - DNA, 100 bp, Zea mays
  Clone ID: LIB3114-007-P1-K1-C5
taaaaaaaaaaaaagtttgaaaagtaaagtggcggacggttatagtgtatccaagattacgaactgggggatgggggggtaattggttttggttttttta

SEQ ID NO: 81751 - DNA, 428 bp, Zea mays
  Clone ID: LIB3114-007-P1-K1-C7
tacggctgcgagaagacaacagaaggggatccacatgaaaacacaagcacatcctggaaattgggctcattgagaaacagagactatctcgacaaaatgaaacacgtttgcgtagcattcttagctctacaagttgtgtaagtccttacaattattgctgcagatccagcatggaagggctacgattgtcaaaaggcataaaggtcactaaagtattgcatggaatacctcactggtgatgttgatagcccttcatcttcatgttgcaatggtgtgaaggaattgtaagcatccgctccatcaaaagatgaaaaaattggtgaatgtcagtgctttgaaaatgcactaactacaatttctaattttaagcatgactgatccttctgcacttgctaaggaatgtggtgttgatgtcgtcattcccatct

SEQ ID NO: 81752 - DNA, 358 bp, Zea mays
  Clone ID: LIB3114-007-P1-K1-D11
aaaaaaaaaaaaaaaaaaaaaaaaaaaaaaaaaaaaaaaaaagaaaaaaaataaaagggaaaaagggataaaaaacaaataaataaaaaaaaaataattataatttattaaaaaactaaaaaaaataaaaaaaaacgggggggccctttttgggtgactaggtaatctcctggggttttccaacttaatagcttttttttgcttccccttttatgaattttgtgggcctagttttaaaacctggggggatggaaattccttggggttccgcatcttaattggttaatggaacaccccctttttccccgctttataattagagaatggggcggttacgtgcaccttttccaatatattt

SEQ ID NO: 81753 - DNA, 440 bp, Zea mays
  Clone ID: LIB3114-007-P1-K1-D12
gtagacaaggaaagtgagagggctgtcacgaaaaaggagggaattgaatttgccagggaatacggttgtttgtttctagaatgcagtgcgaaaacaaaagtaaacgtagaacagtgttttgaggaactggttctaaagatcttagacacgccaagcctcctggcggatgcttcctcagcaggggtcagcaagaagaacatcttcaagcagaaggctccagaagctgacgccgccacaggcagctgctgttaacatggttttggtcctgtatattgctatatgtggtgaagacaattggcagcagctatataatgatgtatcaagttaaacttacctgacaatatgtagtcttgcctcccaaccgcagctaagtagcagaggcacgggtgggtggcatcaataccggcatgatacagtatcagacactgtcatctatataa

SEQ ID NO: 81754 - DNA, 165 bp, Zea mays
  Clone ID: LIB3114-007-P1-K1-D2
atttttgggtttgttggcttggattgaatttttgggtttgttagcttggattaaagccagctttgttcgtgactgttccaactataatttgtagagacaaaacattgtaaaattgtagtagaagtcaatatgaattaaagctgagccaaccggccgtttgttcta

SEQ ID NO: 81755 - DNA, 121 bp, Zea mays
  Clone ID: LIB3114-007-P1-K1-D3
aaaaaaaaaaaaaaaaaaaaaaaaaaaaaaaaaaaagggcggacaatataaaaaaaaccaaactggcgttcgggggcatgcgacgtgttagctcttttattgacccacctaaattcatttt

SEQ ID NO: 81756 - DNA, 112 bp, Zea mays
  Clone ID: LIB3114-007-P1-K1-D4
aaaaaaaaaaaaaaaaaaaaaaaaaaaaaaaaaaaaaaaaaaaaaaaataaaaaaaaaaacaaggggggatggggctaatcgggagtaagaacaatttctttcccatccttt

SEQ ID NO: 81757 - DNA, 123 bp, Zea mays
  Clone ID: LIB3114-007-P1-K1-D6
tacagattttcccggccacttttcggacaaaaaaaaaaaaaaaaaaaaaaaaaaaaaaaaaaaggaaaaaagggaaaaaaaaaaaaaagggggggggaaataaaaaaatagaaaaatcgaaaa

SEQ ID NO: 81758 - DNA, 178 bp, Zea mays
  Clone ID: LIB3114-007-P1-K1-D9
aaaaaaaaaaaaaaaaaaaaaaaaaaaaaataaaaaaaaaaaaaataaaaaaaaaaaagaaaaaggggaaaaaaaaaaaaatagagaaaaaaatggggcggccgttttagaggatccaagtttacttaccctggcttgcaacgccatagcttttttttaggggcacctaaattaaatt

SEQ ID NO: 81759 - DNA, 338 bp, Zea mays
  Clone ID: LIB3114-007-P1-K1-E10
tgaaactgaaatgctgcttgcatcgcgcgcgcagattccaggactatctgccggtacctgtgcgcgcagttcccggacgacgggtacaagaagctgtacggcacggggtcgctggagcgggcgtccatagagcagtggctgcaggcggaggcgcagagcttcgacgcgccgagctcggagctggcgttccagctggcgttcgcgccgcacctcaaggacgtgcggtccgacgaggcccgcgtcgcggagaacgagaagaagctgcacagcatgctgggcgtttacgacgacatcctttgcaagaacgagttccttgccggcgacaactttacactggg

SEQ ID NO: 81760 - DNA, 379 bp, Zea mays
  Clone ID: LIB3114-007-P1-K1-E2
aaaaaaaaaaaaaaaaaaaaaaaaaaaaaaaaaaaaaaaaaaaaaattaaaaaaaaaaaaaaaaggggatatgggtaaattagggtgattgttttaaaatcttatttgttctgtcctttctttttttctcttttttctctttcgtttctcgctcttttgttttttttcttttggtccctcttttatttatttgattgtctttcttttttctccttttttctctttttcttctctctccttttcccctattttttttgcctggcactttcttcccctttcttcctttttgttttttttggcttaagtttcccttctcttgtctctttttttctttataatgttttcgtttccctttattggctttatttttttctcccct

SEQ ID NO: 81761 - DNA, 178 bp, Zea mays
  Clone ID: LIB3114-007-P1-K1-E4
aaataaaaaataaaaaaaaaaaaaaaaaaataaaaaaaaaaaaaaaattatgaaaatgaaaaaaacggggaaattggaaatataatagggtgggccttatatctaaacaccttttcttacctttaatccatcttcttttcttttttctatccctttttttttcccctctctgtttttt

SEQ ID NO: 81762 - DNA, 380 bp, Zea mays
  Clone ID: LIB3114-007-P1-K1-E7
gcccaataagctaggactaccgaagggcagcaagatggccatcgttcgtgagatgatctacggcgttgaccgctacagatactggcgtgtcaacattgctctggttaatggcattatgcaggagatcaccatgtggagcacgtgatggatctaatcgcaactgtatcgatacaattatgatgttggttaaacatactaaacccacaaggctatgtgtgactatgatcaactttttatgaacaggtatgtgacctttattattgtcttgacttgtggtggcaccaatatgcgtctgctctagaggactctagtttacatacgcttgcttgctactgcataactttttctttggtgagcacctaaatttaatgaacgggcat

SEQ ID NO: 81763 - DNA, 447 bp, Zea mays
  Clone ID: LIB3114-007-P1-K1-F1
gagcttggaaggggtgcacatcctgcaagctacatggttgaagagatatggcaggagctttctaaagcaaaatacatcgaatgggagagcttatcaagagaccgaacttgtcaactgcaaaagctgaaggtagcatgtaaagaggccctaacgagttacaacagccttgataacccagccgcaggtgcgccagtagaacagctaaatgagctcgaggaagttttcaagaaggctgcaaagactgatactccagcagaagtacctgaccatctctgttgcaaaatcacacttgatatcttcagagacccggtgatcaccccgagcgggattacctacgagagggccgtacttctcgaccaccttcaaacggtgggggaggtttgaccccgtgacccgtgaggctcttgaaccgcaccaactggttcctaatcttgccatcaaggaagc

SEQ ID NO: 81764 - DNA, 339 bp, Zea mays
  Clone ID: LIB3114-007-P1-K1-F10
ggacatggtccggcgcggcttccgcttcgtcggccccactgtcatccactccttcatggaggcggtcgggctcaccaacgaccacctcgtctcgtgcccgcgccaccgcgtctgctccgccgccgcccgcgtaaataactgattctgctgacgaccaccaagcaaaacacaagagggaattatctaaggacaaccaagacgagagagagagagagaggtagcagtagtaatatacaaaagagagtgttggcggtttgcatgtgtgtatgatgacccagtgtgcttgtgtagattaattacggcctctgattagcgaatgaatgatcttgcttgctgtga

SEQ ID NO: 81765 - DNA, 197 bp, Zea mays
  Clone ID: LIB3114-007-P1-K1-F11
aaaaaaaaaaaaaaaaaaaaaaaaaaaaaaaaaaaaaaaaaaaaaaaaaaaaaaaagggaaaaaagaaaaaaaaaaaaaaaaaaaaaaaaaaaaaaaaaaaaaaaaaaaaaagggggcggccgttttaaaggatccaagtttacttcccctggcttgcaaagtataaacttttttatagggtcccctaatttaaatt

SEQ ID NO: 81766 - DNA, 313 bp, Zea mays
  unsure at all n locations
  Clone ID: LIB3114-007-P1-K1-F2
agaagctctgccaacttttagagcagaatccaaaacttatgcaaatgctccaggatcgcattggccagttgtagtcgcactggaggtgctattgtgaaagtgaaatctgatgctggtcgatcgctaggttcctagagtatggtgttgttttgttttcggctatggctgtagctagatgaaagcaactgccagcttgctagtcgccgaaatgtattcctatgtacattatatgtaactttgttctgtaatgtgaaaatttgtaatgttnaaaaaaaaaaaaataaaaatataataaaaaaaaaattattggggg

SEQ ID NO: 81767 - DNA, 430 bp, Zea mays
  Clone ID: LIB3114-007-P1-K1-F4
caaatgtctgtccaggatgcaaacatgtccagtgacactgatatgagtaaggtgtttgaagacagaacgtttgtgtcatctatccttaattcgcttcctggtgttgatcccaatgatccatctgttaaagatttgctggcatcattgcacagccagggagagcaagagaagaaggaagacaagtcagacaaaacagaagacgagaagaactgatgtagccatgttcatgcttccatgctcacaaagaaattgaacattggtctgcattggctgcgcttactctcttggctatgaaatttgcttatcctcatgtaacagtgctttgtttataacttaatgccgagggaatttgtattgtgactgcaacaatcttctcgtcataaatgttcaagtgatttcgtgtctcaaaaaaactaataaaacttttcct

SEQ ID NO: 81768 - DNA, 99 bp, Zea mays
  Clone ID: LIB3114-007-P1-K1-F5
aaaaaaaaaaaaaaaaaaaaaaaaaaaaaaaaaaaaaaaaaagaaaaaaaaaaaaaaaaaaaaaagggaaaagggcaaaaaaataaaaaaaaaataaat

SEQ ID NO: 81769 - DNA, 325 bp, Zea mays
  Clone ID: LIB3114-007-P1-K1-F7
aacacgcgtacggctgcgagaagacgacagaaggggagatgtagaggtataaaacggagaaagggcacggcgaggaaaactacactattgccgacaccatgctgaaatctacccaagagaatggcggtgtgtgtgagaggtcataacattttttgggatgatccaaaagatctgtctgattgggttaggaccctatcacctgcggatttaacgggcgcagcaacaaaaagaatgaattgggaactctcaagattcaccggagtactgattggatgggatgtgatgaatgagaacctgcgttttcactgtgacgaggacagatccg

SEQ ID NO: 81770 - DNA, 165 bp, Zea mays
  Clone ID: LIB3114-007-P1-K1-F8
aaaaaaaaaaaaaaaaaaaaaaaaaaaaaaaaaaaaaaaaaaaaaaaaaaaaaaaaggggaaaagggaaaataagagaaaggggggggcctttttataagatccaattttacttacccgggtatgcgacgtttttgttcttttatagtgccacctaatttaaatt

SEQ ID NO: 81771 - DNA, 75 bp, Zea mays
  Clone ID: LIB3114-007-P1-K1-F9
aaaaaaaaaaaaaaaaaaaaaaaaaaaaaaaaaaaaaataaaaaaaaaaaaacatagggggaagggggacaaaaa

SEQ ID NO: 81772 - DNA, 445 bp, Zea mays
  Clone ID: LIB3114-007-P1-K1-G2
cgacaagcacgactgcaagttcgactaccggactgctgccagggacgccattgccaaggctaatccggtggtgaaggcagacaagctcgacaagatctagggggggttccctacggttgggtatcaggaagattgtaaaccgcggtaactcgtcatgcggaactgctgccttgccccccgcgcctttctcttccatgtttgctgctacaatcttgttgttgggcattgcagtgcacggtgcacacttgtgtagcccgcctcgagaattcctgcctctgcatctggtcagttctaaaatgatttgcatgttggctatgttgtgtaagctctatttatggtggtctcgctgagacgggtatttggcttcgcagttatctagctatgtgatgtactgttgtcttgtcccttggtattatatggtacactgcaaccagtaatagtaatc

SEQ ID NO: 81773 - DNA, 226 bp, Zea mays
  Clone ID: LIB3114-007-P1-K1-G3
aaaaaaaaaaaaatataaaaaaaaaataaaaaaaaaaaaaaaataaaaaaaaaaaaactaaataagggaaaagggaaaataaaataacaataatttgggcggcccttttattggtatccaaggttccctacctttacattctacgccctggctcttctttgttgtcacctaaattaaattcattggccgcctttttactatttttttggctgggaaaactctggct

SEQ ID NO: 81774 - DNA, 177 bp, Zea mays
  Clone ID: LIB3114-007-P1-K1-G4
ctgtcgcatggagtaccggtccggaattcccgggaaaaaaaaaaaaaaaaaaaaaaaaaaaaaaaaaaaaaaaaaaaaaaaaaaaaaaaaaaaaaaaaaaaaaaaaaaaaaaaaaaggaaaaagggaaaaaaaaaaaaaaaaaaataaaaatattaataaaaaaagtgcacatattt

SEQ ID NO: 81775 - DNA, 77 bp, Zea mays
  Clone ID: LIB3114-007-P1-K1-G5
tccctgttcgacccacacgtacacccacgcttcctaaaaaaaaaaaaaaaatacaaaaaaaaataaatataaaaatt

SEQ ID NO: 81776 - DNA, 67 bp, Zea mays
  Clone ID: LIB3114-007-P1-K1-G6
aaaaaaaaaaaaaaaaaaaaaaaaaaaaaaaaaaaaaaaaaaaaaaagtacaaactaaaaaataggg

SEQ ID NO: 81777 - DNA, 270 bp, Zea mays
  Clone ID: LIB3114-007-P1-K1-G7
tacagatgcgagacgacgacagaagggggccttcaatctattcactggataaggagactccggggcaaacatactgcatgtgtgtgtgccatatactcactcttcaatgctggggtgaggaccactccatacttacttccattgctatgatatggggcataaaaagcctgatacatatggcgggcacaagcacggataaagtggaggcatgaacagtttcaagttatgacaggcatagtgaaaccaaggcattcagaggattcaaagact

SEQ ID NO: 81778 - DNA, 104 bp, Zea mays
  Clone ID: LIB3114-007-P1-K1-G8
gtgcagtaccgaacacgaatgcccgggtcgacccacccgtccgaaaaaaaaaaaaaaaacaataataataaaaacaaaaatcaaaaaaaataaataaagggggt

SEQ ID NO: 81779 - DNA, 413 bp, Zea mays
  Clone ID: LIB3114-007-P1-K1-H1
cccacgcgtccgaaaaaaaaaaaaaaaaaaaaaaaaaaaaaaaaaaaaaaaaaaaaaaaaaaagggggaaaattaaaaaaaaaaaaaaaaaaaaaaaaaaaaaaaaaaaaaaaaaaaaaaaaataaaaaaaaaaaggggggaaaaaataaaaaataaaagggggggggggttttaagggtaaaaattttcgttcccgttgtttggaactaatttttttttttttggggggccttaaataaatttagtgggggggggtttaaaaaggttgggatgggaaaaacttgggggtaccccaattttttggcttttgggaaaattcccttttgcccggtggggttaaatataaaaaggcgcggcccgtttttgtttttcaaaaggggcgccccctttatggggaattggaacccccctt

SEQ ID NO: 81780 - DNA, 111 bp, Zea mays
  Clone ID: LIB3114-007-P1-K1-H12
cccacgcgtccgaaaaaaaaaaaaaagaaaaaaaaaatataaaaaaaaaaaaaaaagggatatgggggaataaaaaataatgggggggtgcaaaaaaaaaaacttaatttt

SEQ ID NO: 81781 - DNA, 449 bp, Zea mays
  Clone ID: LIB3114-007-P1-K1-H2
acgcgtccgagggtctgcagatgtctgagatacctttgacggacagctctccccctaaagatggtcaacagaaacaaccactggctgccatcagtgagcgatcaggagctgactatcagaaaagtgataatgttgaggatggcggcgacggcgtcgaagatgacgacggggatgaatggttggaagaggaagcatgggacccgggaaacacgcaaattccgatagcagatgatgaagacgtgtctttcagtgatctggaggaggaagacgatggtgcggcctgacatcgcctgtaggcttggcttgaccgtactgcttacgtagtctgtgcttcctgttccgttatacgattggtacaattgtcttgggtgatgtctaatacacgctctcatagtctcaaaaaaaaaaaaaaaagggggggcggtctaaaagatcaaagttacgtacgc

SEQ ID NO: 81782 - DNA, 156 bp, Zea mays
  Clone ID: LIB3114-007-P1-K1-H3
acctagttttaaatcgagcgcgcgctctataggagacacacgctcacacacgcgcgcatgcgacgatatatcttttatatagtgacatctaaacaaaatactgtgcgcggcgttacacaacgttgactctgaaaacactgtggcgacacaaatcta

SEQ ID NO: 81783 - DNA, 53 bp, Zea mays
  Clone ID: LIB3114-007-P1-K1-H4
aaaaaaaaaaaaattcatataataactataacaaaaaaaaaaaacatttggac

SEQ ID NO: 81784 - DNA, 153 bp, Zea mays
  Clone ID: LIB3114-007-P1-K1-H8
aaaaaaaaaaaaaaaaaaaaaaaaaaaaaaaataaaaaaaaaaaaaaaaaaaaaaaggggaaagggggaaaaaaaaaaaaagaagataaaaaaataataaaaatataataggcggttcctaaattaagatatataataaaagttctgtttttt

SEQ ID NO: 81785 - DNA, 52 bp, Zea mays
  Clone ID: LIB3114-009-P1-K1-A1
cccacgcgtccgaaaaaaaaaaaaaaaaaaaaaaaaaaagaacaaaacaaat

SEQ ID NO: 81786 - DNA, 317 bp, Zea mays
  unsure at all n locations
  Clone ID: LIB3114-009-P1-K1-A10
taaaaaatataaataaaatatcaaaaacaataaaaaaaaaaaaacaaaattacaaaaaaaagcgagaaaataactaaagggatggagtaaaaaatgggccaccactcttgcggtccctttttttcctccccttttttgcaccctcttncctcttttattgtttccttcttagttcatcccccttccctcttttttactccttctttccttgctatcccctggcatcccccttcttatccccctttcagcccccccccctttctccccctctctttattccccccatgcttcctcctttctccctttctatttttttt

SEQ ID NO: 81787 - DNA, 55 bp, Zea mays
  Clone ID: LIB3114-009-P1-K1-A2
aaaaaaaaaaaaaaaaaaaaaaaaaaaaacaaaaaaaaaaaaaacaaacttacaa

SEQ ID NO: 81788 - DNA, 442 bp, Zea mays
  Clone ID: LIB3114-009-P1-K1-B11
agaaaaaaaaattcagattcaaggaaaatggttttcattcggatagtgagcggacagaaaggacttgaacgtgaaatatcttgaaacacatgggcatgccggtccctgacattacatatcacaagtatacccgtacgtacgcgatgatctggctgacacaacacaacaacatatgagtttaccgatggagctggtagcgtaattagcggcccatcccctgcgccgtcggcgggtacatcgtcatgccggcgccggcgttattattggccgccttctgggcgttgacgtcccagccgagcgcggggtccaagccgcgtgccctgagctccctgtactgctggcagagcgcgcacggctcgcagcagaagtggacccaagaatcgcagcatccgacgtcggggagccccagctgcgcgcgcatcttggagcgtgtcgtgcagga

SEQ ID NO: 81789 - DNA, 306 bp, Zea mays
  Clone ID: LIB3114-009-P1-K1-B9
aaaaaaataaaatatacaaccatatataaaaaatcaaaaataaaaaaaaaattttaaaatggggagaaactaattaaaaaaatatatattaaaaatataaatatacttttataaaaaaattcctaattaatttttattttcctttcagaaaccatatggtgctcctcttttttttttcccctcctttcttcttctctctttttattttttatttcttttttttctcctcctattattattttttttcccccttttttcccctttttctctcgctatatccccgcgcttcccccatctttttttttt

SEQ ID NO: 81790 - DNA, 55 bp, Zea mays
  Clone ID: LIB3114-009-P1-K1-C10
ttaaataaaaataaataaataaaaaaaaaactaaaaaaaaaaaaaaaaataaaaa

SEQ ID NO: 81791 - DNA, 391 bp, Zea mays
  unsure at all n locations
  Clone ID: LIB3114-009-P1-K1-C11
cccacgcgtccgggaagattgtaaaccgcggtaactcgtcatgcggaactgctgccttgcgcccccgcgcctttctcttccatgtttgctgctacaatcttgttgttgggcattgcagtgcacggtgcacacttgtgtagcccgcctcgagaattcctgcctctgcatctggtcagttctaaaatgatttgcatgttggctatgttgtgtaagctctatttatggtggtctcgctgagacgggtatttggcttcgcagttatctagctatgtgatgtactgttgtcttgtccctgggtattatatggtacactgcagccagtaatagtaatctgcaactgtgcgttaaatggtcaaaaaaaaaaataanttaaatatgttaattaaatatt

SEQ ID NO: 81792 - DNA, 174 bp, Zea mays
  Clone ID: LIB3114-009-P1-K1-C8
gatgattgataactaataattaaggctactagatgatcgttgagatgtttcttcttctgggggttcctcctcctcttgcgcggtgttcatatagctggatggatcaggacttgtgctgatcggtcgatggatttcatccatgtgtactcgtctgctgttctttccttcccaatt

SEQ ID NO: 81793 - DNA, 374 bp, Zea mays
  Clone ID: LIB3114-009-P1-K1-C9
aaaaaaaaacaaaaaaaaaacaaaaaaacaaaaaaaaaaaaaacaaaaaaaaaaaaaaggggcgggaactatacacaggggggggtcccataccacactacaataaaagcctccatatctgggccccctcgtttcgttggtccccgcttcccccccccgggcgcccccctttttggccccccctttttcccccccgggccccccccctccgcccccttttttccgccccccttttgggtatccccggtgcgcccccctccctttgtcgggccggggggcccccccgttttcccccccttttggggtgcctgtggcgcccccccttcccccccttcccgggtggggggggggggggtcggcgttggcctcccccc

SEQ ID NO: 81794 - DNA, 231 bp, Zea mays
  Clone ID: LIB3114-009-P1-K1-D1
cggacgcgtgggaaaaaaaaaaaaaaaaaaaaaaaaaataaaaaaaaaaaaaaaaataaaaaaggagggaaacttacacaaacttggataaaaaataactaaaacttaaatgcaacataaatatctattaatctgggcggccctttttaagcggtcccaacttgtagttccctttgcttgtacccccctttgctttccttggggggcctccagtttacttcagttggccta

SEQ ID NO: 81795 - DNA, 98 bp, Zea mays
  Clone ID: LIB3114-009-P1-K1-D10
taaaaaaaaaaaaaaaaaaaaaaaaaaaaaaaaaaaaaaaaaaaaaaaaaaaaaaaaaaaaagaggaaaaaaaaaaaaaaaaaaaagaaaaaaaataa

SEQ ID NO: 81796 - DNA, 288 bp, Zea mays
  unsure at all n locations
  Clone ID: LIB3114-009-P1-K1-D2
gatgattcgatcatagagcttgcaaacgaggtgaggaaggtgctcaacagaacaaaggagaccaagatcactggtgccaatgcttgcatgaaatcacatgcccctcttgtgcacctgtccgtgcttccagaaggcaccgttgtggactcnagatagcgacctctactcggaatttactttcagctcttgcatgtttgtggatgtggccatcatgtactgattatcccttttcaacagttgtcgagaggctgtaaaaaaaaaaacagctaaaaaaccaaaaattactaa

SEQ ID NO: 81797 - DNA, 275 bp, Zea mays
  unsure at all n locations
  Clone ID: LIB3114-009-P1-K1-D3
gatcctcccgtatcgtcgtccctccccgtgtgctacgcgtgcgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgtgtatgatcgtggtacgaggaccgaaaaaatgtatgcaactctgatttacttaaaaaaaaaaaaaaaaaaaaaaaaaaaaaaaaaaaaaaaaaaaaaaataaaaatn

SEQ ID NO: 81798 - DNA, 104 bp, Zea mays
  Clone ID: LIB3114-009-P1-K1-D8
acgcctcagtaccgtccgtattcccgctcgacgcacgcgtccgtttttttttttttttttttttttttttttttttttttttttttttttttttatttgggggg

SEQ ID NO: 81799 - DNA, 305 bp, Zea mays
  unsure at all n locations
  Clone ID: LIB3114-009-P1-K1-E11
aaaaaaataaaaataaaaaagaaaacaaaataaaaaaaaacaaaataaaatacacaaacgggggacataataacaaaaaaaaaagagtaacctaattagctattcactggccgtcgtccttcaatagttcattcttgaataaaccctaaacangcggcggcttgtttttctgtacccacctttcctcccccgccttttggcgtctttgccttttgtttgggtgcccctatacctattcttccgcggcgcgttctccacggtgattgcggcacaccccgtggcgnccccaagtgttcggcggttgg

SEQ ID NO: 81800 - DNA, 451 bp, Zea mays
  Clone ID: LIB3114-009-P1-K1-E2
acgacgagtacaagaaggaggagaaggagcacaagcacaagcagcacctcggcgaggccggcgccatcgccgccggcgccttcgcactctacgagaagcacgaggcgaagaaggacccggagcacgcgcaccgccacaagatcgaggaggaggtcgcggcggcggcggccgtcggctccggcggcttcgccttccacgagcaccacgagaagaagaaggaccacaaggaggccgaggaggccggcggcgagaagaagcaccacttcttcggctgattgatcctcccgtatcgtcgtccctccccgtgtgctacgcgtgcgtgtgagagtgatatcgagcgcccgccgtgttgtgcgcgcgtacctatgtatgcgctcgtgtgatgcacgaataagcgtggctacgtaatctatcgtatgtatacgtgtgtgtatgcatgtgcttgtgtatg

SEQ ID NO: 81801 - DNA, 146 bp, Zea mays
  unsure at all n locations
  Clone ID: LIB3114-009-P1-K1-E4
aagacacgtnctagactgaggagacggaccacacacacaagcagtaccttggcagaggccggggccatctcctccagagcctacgcactctacgagaagcactaggcgaagaacgaccctttgctcgcgcaccgacacaagatcga

SEQ ID NO: 81802 - DNA, 253 bp, Zea mays
  Clone ID: LIB3114-009-P1-K1-E8
aaaaaaaaaaaaataaaaaaaaaaaaaaaaaaaaaaaaaaaaaaaaaaaaaaacgaacgggggggggaatacaaattaacggacgctttcatcctccgttctaacttatcctatctttccacctaaatctaattcactgatcgtccttttacagcgtcccctactgttaaatccctggccttacccaaataaatcgccttgtggaaaaaccccttttttccccaacttatatatcctaaaaggcccgcacctt

SEQ ID NO: 81803 - DNA, 238 bp, Zea mays
  Clone ID: LIB3114-009-P1-K1-E9
gcataccaaccctgcatgcagggccagcttattatatataatatctgaggtggagcatgaggggatctggctgcgtactgcaagcaggcctaatacgccgcctgcgcgttcctcctattacacatataggcccctccctgcgtgtatgcttgttaccgtcgtgtcgaaccttgtactacgaggctccatcgaacatcgatggcttgcttctttatcacaacatgtttgaataaacgct

SEQ ID NO: 81804 - DNA, 289 bp, Zea mays
  unsure at all n locations
  Clone ID: LIB3114-009-P1-K1-F10
agaattattggtctcaataaatgttattaatttagcaaaaaaaaaaaaaaaaaaaaaagggagaaaaaaaaaaaaaaaaaaaaaaaaaaaaaaaaaaaaaaaaaaaaaaaaaaaaaaaaaaaaaaaaaaaaaaaaataaaaaaaaaaaaaaataaataaataataaataaaataaattanatgggggccccccttttaggggcccaatttttccctccccgctaccctaacattattattttttttttaggtcccccaaattaaattccatggccccttgttatccccc

SEQ ID NO: 81805 - DNA, 166 bp, Zea mays
  Clone ID: LIB3114-009-P1-K1-F12
acccacgcgtccggatatgcaataacctaccttcggcgtgtgtctacttgcttatcatagtgagtgttcgggggtgatagatgatgtactgtcacgaactcacgtgtgtatgagagaggatacatggtaagactatcactactagaaaaaaaaaaaaaacacccaa

SEQ ID NO: 81806 - DNA, 336 bp, Zea mays
  Clone ID: LIB3114-009-P1-K1-F2
acgcgccgagggctgcctatatgcatgcctgttcactgcgtgctgctgcttctgctgcttcgagacctgtgggggctgcctcgaggctatatgctgctgctgctagttctgctatggagggcatgggcgcgcattattctggagatgtggccatgcgcgacacccaccgccgaatataatgctcttcttatatgcacgcacgttagaaatgcgctatagtgtgtatggggtgatatcttttgtgtgtgtgcgcgcatcttcatttgcactggaaaatgctctattatttgtggaagggcttgtaatctgttgtatgtatcttgggcagatgaactc

SEQ ID NO: 81807 - DNA, 92 bp, Zea mays
  Clone ID: LIB3114-009-P1-K1-F3
tattaaaaaatgacctacgagaagaaaaaacaaaaattggcagaccaaagaggtaaaagcaggggggggtctttcaccgggggggggggggg

SEQ ID NO: 81808 - DNA, 290 bp, Zea mays
  Clone ID: LIB3114-009-P1-K1-F5
attgaagagggagacggacccaagtgatgcagttcatgtgttatctgtatcaatccctatggggataagctgtcatatattttctcgaaactatcttctgttgattttgtgtgaagtgtacttttaatggcacgggccacgtatttccttggaaacgaccatgtggagttattttttcccccattttctttcctgagatgggctgtgtatttgcttgaaagataaggatgatattatctttgtatttgaactctagatgcttaaatgaagtgatcatcctggatggagat

SEQ ID NO: 81809 - DNA, 251 bp, Zea mays
  unsure at all n locations
  Clone ID: LIB3114-009-P1-K1-F9
aaataaatataaaactaaataaaaaaaaacaaaaaattaaaaaaaaaaaaaaataaaaaagaggggggaatataaaaaaatgggcttcttcttttaatatttctaaacttgctgacccctttatacagattcaatttttcttctttagccccccctaattataattttctaggccggtanccacaacttatttctctggcaaatctcttacataacccaactttaattacctcctgataatcccctttttt

SEQ ID NO: 81810 - DNA, 122 bp, Zea mays
  Clone ID: LIB3114-009-P1-K1-G11
cccacgcgtacgggggggtggggtggggggtgcgttgattttataactgtctttttgggggggttggaagctcgggactcatttttattcacttggtaacttattgcatactatcaaatgtt

SEQ ID NO: 81811 - DNA, 61 bp, Zea mays
  Clone ID: LIB3114-009-P1-K1-G3
aaaaaataaaatttaaataaaaagaaaaaaaaaataaaaaaaaaaaataaaaaaaaaaaaa

SEQ ID NO: 81812 - DNA, 183 bp, Zea mays
  Clone ID: LIB3114-009-P1-K1-G6
acaacaacccggagctcaggaaccggtgcggagcagggatcgtgccgtacgaactgctcaagcccttctccaagccgggagtcaccgggaggggcatccccaacagcatctccatttgacccgtccgtcctctccatccaatgggggtttgccttattgcgtgcacgctagctagctgcttgg

SEQ ID NO: 81813 - DNA, 200 bp, Zea mays
  Clone ID: LIB3114-009-P1-K1-H3
aaataaataaaaaaataaaaaaaaaaaaaaaaaaaaaaaaaaaaaaaattaaataaaacaaaaggggaaaaacataaaagacgaggagattgtagatatataaagacaaaaaaaaaggggctcccttttcaagggtccctactttccttccccttgcatccacctgttgtgcctcttattttacgccccctaaatttaat

SEQ ID NO: 81814 - DNA, 302 bp, Zea mays
  unsure at all n locations
  Clone ID: LIB3114-009-P1-K1-H7
agctctatttatggtggtctcgctgagacgggtatttggcttcgcagttatctagctatgtgatgtacaaaaaaaaaagaaattgtttaatttaatattaattaaataaagaaaaaaaccaaatggccgacctttcaaaaaaaaaccagccaaaagggccggccgttttagagtttccacccttccacccccgggcttgcatcaattaaactctcctatggggcccccaaatttcaatggctggaccctcgttntaccccgtcttaaccggtaaacccctgccctccccatacttaatgggt

SEQ ID NO: 81815 - DNA, 63 bp, Zea mays
  Clone ID: LIB3114-010-P1-K1-A12
cctgcagtaccgttctcgaatacgtgtcgacccacgcgttcgatcgatgatgtttgaggaacc

SEQ ID NO: 81816 - DNA, 119 bp, Zea mays
  Clone ID: LIB3114-010-P1-K1-B6
aaataaataataaatataaaaaaaaaaaaagggaagacgatttaaaaagataacaaacttacatgcgcgtgcatgcaaaaaaaataaatagtgctctagcgtcacctaataacaattct

SEQ ID NO: 81817 - DNA, 70 bp, Zea mays
  Clone ID: LIB3114-010-P1-K1-B8
acaacaaactatatatgttgcataaaaaaaaaaaaaaaaaaaaaaaaaaaaaaaaaggaaaggagaaaaa

SEQ ID NO: 81818 - DNA, 467 bp, Zea mays
  Clone ID: LIB3114-010-P1-K1-C10
taataatctcgtctatctatagtaaaaaaaaaaaaaaaaaaaaaaaaaaaaaaaaacaaataggggaacataaaaaataaagaaacggaaaaaaaaaattaaaaaaaactaaaaaaaactggggtcgcccgccttaaaggtcccacgtttcctaccccttgatgcccacgttaaatgttttttttagggttccctaaatttaattccctgcccccactttttacaacttcatgactgtaaaaaccctcgttttaccaaatctaatcgacttgctgcaaatccccttttcccaaattggcatatattcaaaaaggccccccccgttcgcctctccaaacaattgcgcagccttattgccaaatgtgcccccccctttaacgccccattaaacccgggggtttttttttttactcccacattaacctttacatttgccagggccttaaagcccgtttcttatttttttt

SEQ ID NO: 81819 - DNA, 295 bp, Zea mays
  Clone ID: LIB3114-010-P1-K1-C2
cccccccccctttttttttttttttttttttttccaagaaagcttatgaaacaatttttaaagaaaggtgctcataggctttctggcgaaaacaaatggggttcgtgtccttagtcgggagggtgctcttcgtagccgcttttctcctgtccgactaccaggagtttaatgaatttggtgctgatggaggaccatcagctaaggcccttcggaccaaattcaacgtgtttgtcaaaaatgtatctgctcatctgggagtagctgtgccacacatttagttgaagcatgtgattgc

SEQ ID NO: 81820 - DNA, 336 bp, Zea mays
  Clone ID: LIB3114-010-P1-K1-C5
aaaaaaaaataaaaaaaaaaaaaaaaaaaaaaaaactaaaaatataaaaaaaatcataaataagggcaaggggaaaacaaaaaaaaagcaaataaaaaaaaaaaacctaacttgtcttcccttttactgcttccaacctccctcccccatgcttccccccctccttctcttaacataattccccaaaaacaatttccccgttcctccttttaacaatagctccacagaaaaacccctctgcctccctacctaaaattcctcacaccccaatccccttttttccccctcccttatatccctaattacccttccccttttccccctcccacctttttc

SEQ ID NO: 81821 - DNA, 271 bp, Zea mays
  Clone ID: LIB3114-010-P1-K1-C7
aaaggattctggccatcaacagaatgggaaggcaaaatctaaccaagaagaaaacgaggactgcaaaaacgagaaggataaacccttgtcgtaattcgttttctacgacaaaaaatgaatcctaatctttgtcggatatctatttgtgctcttgttgagagtctcttcagctattgttccaactattattaatatatgtacatgcgtgggagctatgccttgtaataatcaattttcaaaaaataaaaagtattttccctaatttttaaaa

SEQ ID NO: 81822 - DNA, 122 bp, Zea mays
  Clone ID: LIB3114-010-P1-K1-D12
aaataaaaatagttaaaaaagcaaacaaaataaaaagatataacaaacttacaaacacaatagcatagcgggaacataaaatattggggggtgtctcctaaaattccttctcttgcctttcg

SEQ ID NO: 81823 - DNA, 145 bp, Zea mays
  Clone ID: LIB3114-010-P1-K1-E11
gacggtcctcgaggatgctgacgcaatgtgatttctgctcagtgctctgaatgttgtcagcataaattaggtggttatccctaatcaggatattaagttgcaaagataattgaattaataaatgttgtaccgtgcccgatgtgtt

SEQ ID NO: 81824 - DNA, 250 bp, Zea mays
  Clone ID: LIB3114-010-P1-K1-E3
aaaggattctggccatcaacagaatgggaaggcaaaatctaaccaagaagaaaacgaggactgcaaaggcgagaaggataaacccttgtcgtatttcgttttctacgacaaaaaatgaatcctaatctttgtcggatatctatttgtgctcttgttgcgagtctcttcagctattgttccaactattactaatatatgtacatgcgtgggaactattcattgtaataacctctcctcagaaagtaaagag

SEQ ID NO: 81825 - DNA, 444 bp, Zea mays
  unsure at all n locations
  Clone ID: LIB3114-010-P1-K1-E4
tacagatgtatatcagaggtcatgtcaattatccacatgtaggaggagaggaggccccctagggcagagaccttgtgggtgtcgcgtgcgccggatcacattatcttcaagggagcgccgccctccaagaagccaaagttcaggtgaatgctgccttcggcaattcgctcgtgccaaagtgcagcagcttcaagggagcaccacctccaataaggcagctctggttaatgggactccttgaagctttggcccccggagtagacgtgtctgtaggagtgtggtttgttatatctagattatctgcagtagcttagtccatctaaattaaatgtgacagctgaacttttgaagtcgcntcattggggaaacgaaatttaagtctattgaattgttaatgccctcagtgattgtattatttcccttagtccggtggttttccggtct

SEQ ID NO: 81826 - DNA, 197 bp, Zea mays
  Clone ID: LIB3114-010-P1-K1-F10
agatatcaagatagcaacagtgttgaagttgggctgtaagttcttaggttgagaagggatggtagctgagctttttttttttcaatttacatgtgtggtatgttgtatatgagacaggtttttttcctgcttgccgtccagattataaccttggttgggcctgtttaaaaaaaaaaaaaaaaatatataaataatta

SEQ ID NO: 81827 - DNA, 72 bp, Zea mays
  Clone ID: LIB3114-010-P1-K1-F3
aaaaaaaaaaaaaaaaaaaaaaaaaaaaaaaaaaaaaaaggaaaccaaaaataaaaaaaaaaaagggaacgt

SEQ ID NO: 81828 - DNA, 387 bp, Zea mays
  Clone ID: LIB3114-010-P1-K1-G3
aaaaaaaaaaaaaaaaaaaaaaaaaaaaaaaaaaaaaaaaaaaaaaaaaaaaaaaaaaaaaaagagaaaaagaaaaaaaaaaaaaaaaaaaaaaaaaaaaaaaaaaaaaaaaaaaataaaaaaaaaaaaaaaaaaaagggggcgccccttttaaaggaccaaattttacttccccttgcttccaaaaaaaaagttttttttttgggcccccaaaataaaattccttgcccgggttttaaaaacgccggaattggaaaaaccctgggtttcccaaatttaatcgctttgaaaaaaatccccttttccccaggtgggtaaaaacaaaaaaggcccccaccatttccctttccaaaaaatggcccaccctaattggcaaatggacccccc

SEQ ID NO: 81829 - DNA, 275 bp, Zea mays
  Clone ID: LIB3114-010-P1-K1-G5
aaaaaaaaaaaaaattaaaaaaaaaaaaaaaaaaaaaaaaaaaaaataaaaaaaaaaagccagggggtggggaaataaaaaaaattacggacccactctttcaataataacacttattatatagtaggggccgaaattcattaacctttccgttgttcaacatcttaatgggctgggaaatccttttttttaccctttttaatagttattcacctgctccccctttcaactgttggaataataaaaaaataggcctacaccaattgcccttccca

SEQ ID NO: 81830 - DNA, 191 bp, Zea mays
  Clone ID: LIB3114-010-P1-K1-G7
aaaaaaaaaaaaaaaaaaaaaaataaaaaaaaaaaaaaaaaaaaaaaaaaaaaaaaagagaaaggggaaaattatataaaatataaaaaaaaaaaaataaaaatggggcggccgttttaaaggatccaagcttacttacccgtccatgcaacgtaatagcttttttatagggccacctaatttaaattcat

SEQ ID NO: 81831 - DNA, 97 bp, Zea mays
  Clone ID: LIB3114-010-P1-K1-H2
ctgcagtaccggtcttgaattaccggatcgacccacgcgttcgatataaataagatttaaaaataagtaaaaataaaataaataaaaaatttaaaaa

SEQ ID NO: 81832 - DNA, 232 bp, Zea mays
  unsure at all n locations
  Clone ID: LIB3114-010-P1-K1-H9
tctataggatccaagcttacntacgcgtgggggcgagggtatagcgtttggtaggggcacctaaatccaatttactggccgtgggtttacaactgtctgtctgggaataccctgtcgttagccatcttaattgtctttcagaacatttcccttattgcaagtggcgatatatcgaaagaggcccgaattgtttggcctttccaacagtttgtcagactggaatggtgaatgg

SEQ ID NO: 81833 - DNA, 169 bp, Zea mays
  unsure at all n locations
  Clone ID: LIB3114-012-P1-K1-A6
agtatttcgatgatgaccatgattggatcctctggcgtgcaatgcagacttggaagaatgcatggggatctcgcggcgggggcanccatgtcattaggctactggttagcgatatcgcagcacactttggcagttcttgtggaagctctggttgatatgcttgttatcc

SEQ ID NO: 81834 - DNA, 269 bp, Zea mays
  unsure at all n locations
  Clone ID: LIB3114-012-P1-K1-A7
aatactatagtgaattcgtannagttattatatttttaaaactatttacatttatggggagctatgtaacacccggctactgcgnttttttttctatcacgcttactcattttaaccgtttccttcgatcacctgctgctacttgggtcactgctacatcaatttgttaattcgtccttaatatgttcattgaatttaaaactgaacgccaggtgtctttatttggtctttgtttttgtatgtacccgtcatcttgtaatattttttga

SEQ ID NO: 81835 - DNA, 345 bp, Zea mays
  Clone ID: LIB3114-012-P1-K1-B1
ctgctgcaatgaggacttctcgccgcagtggtgggacctcggtaccaccactgcctgggggggaccactggtcccgcgagcgcgcccacctggacgagatggccgagcagatcgacgcggccggcctcctccccgacgacgaggacctcttctacgacgaccagctcgagcagggccccgtcgccgccgcccttaagacagattcggtgctcaaggcgctgaacatgacctccccgaagggcggcggcgacgccccgcgggggttccgggagaaacccaggaacgccgagaagccgaccaagtacgccgtgagccccaagagcaacgcttcccgcgtgatccacc

SEQ ID NO: 81836 - DNA, 138 bp, Zea mays
  unsure at all n locations
  Clone ID: LIB3114-012-P1-K1-B11
gctgattaccgacatctgattatctgttctagtatagtgnnnctcgaacttaggccctctttggaattatagtatttcttataggttttaaaacagtcctatgttatttggtgatactatagtattggagctcaaaag

SEQ ID NO: 81837 - DNA, 87 bp, Zea mays
  unsure at all n locations
  Clone ID: LIB3114-012-P1-K1-C1
tccgggaattccncgggtcgacccaacgcgtccgaaaaaaaaaaaanaaanaaaaaanannnttgaaataaaaaaaaatagatttaa

SEQ ID NO: 81838 - DNA, 429 bp, Zea mays
  unsure at all n locations
  Clone ID: LIB3114-012-P1-K1-C11
gcgtaaggatccatcggaganttaccatgagggatgttgtggaggccctagcaagagtccgggaaataaaggtgtgnnnnagatatcctctgcaagaaccttctgctgcaccaagaaaagtgatgttgaaatctacatccctcaatgggattgtgcctcaccatcctgtcataaccttctctccatcgccgccttcacataaccagcacttgatttcaccaaggtcgtcgacatctgccttgtttcatccaagggcatgctcttctaccctggacgatccgagtgtaagttctataaagaaaacaccacctattatgcgaaggtctagcgtcgaaggcttttgattgtccatatcgttcctttatttccttttcttggatttatttgttactttgttagtagtggagccggttttagctgtgttctgta

SEQ ID NO: 81839 - DNA, 283 bp, Zea mays
  unsure at all n locations
  Clone ID: LIB3114-012-P1-K1-C3
tttacacctgcagtacccttcctnaattcctctgtcgacccactcgtcctaattctaaaacgctctctgcctctcttaaaatccaatcttacttacacattcattcaacctcatagctcttctatattgttggnnnnattcaattcactgtccatctttttacaacctccttacttacaaaaccctatcattacccaacttaattacctttcactacatccccctttctccaactatcttaatacctaaaataccctcacctatctccctttccaacatttac

SEQ ID NO: 81840 - DNA, 121 bp, Zea mays
  Clone ID: LIB3114-012-P1-K1-C4
ggtagcctgcagtaccggttcggaatttccgggtgggagggagcgtccgataaaacaaaaaattaaaattaaattttatataagaagtaaaaatagggaaaaaataaaaggggggaaaaat

SEQ ID NO: 81841 - DNA, 58 bp, Zea mays
  unsure at all n locations
  Clone ID: LIB3114-012-P1-K1-C5
atccagctacgtaccgtgcatgcgacgggtagctgttgtnngnnncctaaattcaatt

SEQ ID NO: 81842 - DNA, 390 bp, Zea mays
  unsure at all n locations
  Clone ID: LIB3114-012-P1-K1-C7
atcaccgttaaccaggcccagtnttgggcggtggcggtggcggcggtggctactgcggcggtcgcggctgtaatgcngnnatggtggcngncgccgtgactgcggttatggcggcggtggcggctacggcggtcggcgcgaatgtggcggcggctgctactgaggcggtggcggctactgcggtcggcgctagggtggcggtggcggctactgcggctgtggttgcagcggctggagggactgatgtgtgggcccatcctggcttcggcccagttatcttatctatttttagtatcgtgttacccgatcgctttctggcaccgtgtttttgtccctgtctaccttttggattatggtgtttggttcccttgttttttcgctttttggttg

SEQ ID NO: 81843 - DNA, 218 bp, Zea mays
  unsure at all n locations
  Clone ID: LIB3114-012-P1-K1-C9
tccatccgtccccgctagacgatcgaggagagagtgagcgcatagcttagttgccngcctctgtcttctgccgtcccggccggttaatttatagtctctactgtgtgttcgtcccatgtgtgtagcagcagcagcaggtgtattgggcgggtatgtaatggtattgcaactatattgggggtaaaaccataataaatgtggaaaaaatgcttggaatt

SEQ ID NO: 81844 - DNA, 59 bp, Zea mays
  Clone ID: LIB3114-012-P1-K1-D4
tcgcctgcagtatccgtccggaatttccgggtcgaccgggcgtcctaaaaaataatata

SEQ ID NO: 81845 - DNA, 374 bp, Zea mays
  unsure at all n locations
  Clone ID: LIB3114-012-P1-K1-D6
aaaaaaaaaaaaaaaaaaaaaatnnnnaaatagcaaaataaaaaaaaaaaaaaaaaaaaatacgaagggataaaataaacctaanggccgtcccttttaaanaatccaaccttacttccccttccatccaacatcatatcttttttttagtcccacctaaattaaattcactgcccttcattttacaacttcctacctggaaaaaccctgactttccccaacttaattccctttcaaaacatccccctttctccaattgtcataataccaaaaaacccctcaccaatcttcccttcccaacaatttctcaccctaaattcctaattgaaccccccctttattttcccattaaacccccccgatgtttttgtttt

SEQ ID NO: 81846 - DNA, 321 bp, Zea mays
  unsure at all n locations
  Clone ID: LIB3114-012-P1-K1-D7
cccacgcgtccgaatttctttnnnatgcgcttctcattgttatagcatattgcacaaatgttgtgtctaatgtattgcgnnnnagaaataagtaatgttcttgcattttgttggcatgcattttgtaccaaaaaaaaaaaaaaaaaaaaaaaaaaaaaaaaaaaaaaaaaattaaaaaaataaataataaaaagggctgtcattaattggggtccacatttaagaatacctcctatcaacataatatttttttaataattgtcatctaataattaaaaactcagtcatatatttattataaacgagctaatcttttaaaaa

SEQ ID NO: 81847 - DNA, 358 bp, Zea mays
  unsure at all n locations
  Clone ID: LIB3114-012-P1-K1-D8
aaaaataataaaaaaataaannnnaacagcggaatattctaaacaacctaaaaaacaagggagggtataaagaatagcggnanaaaataaaaataaaataataacaggggcgtccccttaaaagatccccctctaccaacccccctcatccaacattatacattttctattggaccccctaaaaatatttcccggccccatgtataacaaccgtagtacctggaaaacccccggcttaccccaactaaatccctttggaccactatcccctttttcccacttgcgcataaaacaaaaaggccccccccgatcccctttcccacacattgccccccctaaaagtgaaaaggcacccccc

SEQ ID NO: 81848 - DNA, 74 bp, Zea mays
  unsure at all n locations
  Clone ID: LIB3114-012-P1-K1-E2
taaaaaaaaaaaaaataaaaaaaaatnnnaaaaaaaaaaaaaaaaaaaaaaaaataaaataaagggaggataat

SEQ ID NO: 81849 - DNA, 212 bp, Zea mays
  unsure at all n locations
  Clone ID: LIB3114-012-P1-K1-E5
ctttacccctcattacctgtcctgaattccctgatctacccactcttcctacttatatatcattatatttaatcnnaaaaattatttcagtactttttatctaacaaatataacgtctaatttttgaaannnnatattatcttttcccttttaaaaaaaaaaaaaaaaatatataaaaaaaaattaaaataaaaaaaaataaataaaattta

SEQ ID NO: 81850 - DNA, 103 bp, Zea mays
  unsure at all n locations
  Clone ID: LIB3114-012-P1-K1-E8
gcctgcagtacctttcctaatttccgggtggagggacgcgtacgaaaaaaataaatataaaaaaaatnaagaaataaaaaaaaaataaaaaaaaaaaaaataa

SEQ ID NO: 81851 - DNA, 190 bp, Zea mays
  unsure at all n locations
  Clone ID: LIB3114-012-P1-K1-F1
gttaatgaacaatcgtgttttaagacttcctcttgtgtgttaaaatttaagagtggacatcgctgcctgtttaaccactttatttnnacaccattgcgttttttttactttttgtaatgaaactttttttttgttcattaaattaacctcctgtgttaacaatgattttcttttgtataaactcttttct

SEQ ID NO: 81852 - DNA, 62 bp, Zea mays
  unsure at all n locations
  Clone ID: LIB3114-012-P1-K1-F11
atctacgatttactatgtacatattggggcaggctaaagcaggcgggnaaatggtcccatgt

SEQ ID NO: 81853 - DNA, 444 bp, Zea mays
  unsure at all n locations
  Clone ID: LIB3114-012-P1-K1-F2
tgtacgcctgcagtaccgttccgnaattcccggatcgacccgcgcgtccgccagggcagcagctcctgacgccaagcctatgacgaatacgaggaggagcacaccgagccttttgcggaagctgctagtagnnnnnttggcagcaactaaataatggactgagttagctgacaataggccatttgattctatcccatgtttggtgcatgtagtgtatcatgtttcgtttaccatctctattggcatgatcagagctctggctatcttttcaagaccatgctgagtgtacagaacttggacaatctttggcggacttcggaaaggcgattaagcttttgggctcttgtgaaggatatttgatggaaaaggtgttttctgaagttggttaaaatcaaatatttgttaataaagcttgcaaaaaaagtaaacaagatataattttac

SEQ ID NO: 81854 - DNA, 183 bp, Zea mays
  unsure at all n locations
  Clone ID: LIB3114-012-P1-K1-F6
aaaaaaatatattaattttaaaaannnntttgttggattattacaaaaaaaaattaaaatttaggggtagtgtatagattcggcgcgganannaatcngggcgtcctttttaaatgatccaactttactcccccctgcttgcgacatcttatttcttttttttggtcccctaatttcaatttc

SEQ ID NO: 81855 - DNA, 260 bp, Zea mays
  Clone ID: LIB3114-012-P1-K1-F8
ccctttttaccaccttaattccttttcccccttttcctccatattcctttttaatccccctctttcccctctcctccctttcttccctcccctttccttcaatcccccctttccccaattttcccccctttctccttttccccttttcctctcctctttttcttctatccccccccttccctccttttcttctccttcctttttattctctacccccccctctctcttttttcctctcctttttttttttccctcccccc

SEQ ID NO: 81856 - DNA, 296 bp, Zea mays
  unsure at all n locations
  Clone ID: LIB3114-012-P1-K1-G2
cgcctgcagtaccgntcctgaatacccggatcgacccactcgtacgatattttgatcactgtatgattacactaaacggttacacagtttacagtacacttttggtgggggtgactgttcatgtttactacatttaccttgccctttttaaaacagatgatggatgtatatgtatttggtagttttgaacctaggaatggttggttcttctttcaagttgtctttatataaagctgggttcgtctagacaactttaaaagaagtgttcttttatgatgtgaagcgatttttctgaa

SEQ ID NO: 81857 - DNA, 399 bp, Zea mays
  unsure at all n locations
  Clone ID: LIB3114-012-P1-K1-H2
aaaagagtgaagctcctcggttnnnnttgtacctaggccaacccaggtagagagaatcgcaccccggcagcatcggctgcgactgaagcattaaccctcttaagaaaaaaaaaagttcgctgtgttggaaattcttttcctttctccctagcggtgtttattttgttcattatggtatcgatacctgatgttcttactgatggtgtaagtgggatcctatagtaggtctgtcaagttcaaaaggtattttttttttttcaccctttaccatttggcgtggattatctcgtggcccttgtttgggtagaccttgaggccggcgtaatccttttggatgatatttgcaaataaattgtatattttcttttttaactttaaaaaaaaaaaaaaaaaaatagg

SEQ ID NO: 81858 - DNA, 268 bp, Zea mays
  unsure at all n locations
  Clone ID: LIB3114-012-P1-K1-H5
tcctgaattcccgggtcgacccgcgcgtccgatccccggcatcatctacgccagnnangtcgtaccaagaacacctagctagtcatccttgccgacgacgatccatgtaggtatctgtgtctgttcatatgcctgatgccgacttgtgctgtatgtagttgcttgaattcagtcgtgttcctgttttgctaccgtacccaccccatgcatcatctgtcaccgcgacgcaataatcatagtaataacaagttcagataatcgaattcat

SEQ ID NO: 81859 - DNA, 58 bp, Zea mays
  unsure at all n locations
  Clone ID: LIB3114-012-P1-K1-H6
aaaaaaaaaaatattaaaaaatattantgnggggaaaaaaaaaaaaaatatataaatt

SEQ ID NO: 81860 - DNA, 364 bp, Zea mays
  Clone ID: LIB3114-013-P1-K1-A1
caacttcatcgacgggctgtggtcggcgtgcggcggcgagcggatcatcgtgttcaccaccagccacgtcaagaagctggacccggcgctcatccgcagagggcgcatggacaaacacatcgagatgtcctactgcggcttcgaggcgttcaagttcctggccaagacgtacctcgacgtggactcgcaccctctgttcgacgccgtcggcgagctactccgggaggtggacatgacgccggccgacgtcgccgagaacctcacgcccaagagcctcgacgacgggccggactcgtgcctcgcggacttggtgaaggcgctggaagaggccaagaaggctagcggagccggagaggatgaagag

SEQ ID NO: 81861 - DNA, 126 bp, Zea mays
  Clone ID: LIB3114-013-P1-K1-A10
gtaccggtcctgaattccctggtcgacccactcgtcctaactattattaatattctcatcattcatacctattatatccaatcttactttctcttacatgcggggtattaaactcttgtgtaaaat

SEQ ID NO: 81862 - DNA, 471 bp, Zea mays
  Clone ID: LIB3114-013-P1-K1-B4
tacgcctgcagtaccggtccgaattcccgggtcgccggcgcgtccgaagcacagcggcaacatcggcctcgacgacgtcgtcgagatcgccaggaccatgaggaacaggggcgtggccaaggagggggcgggcaccgtcaaggagatcctctgcacctgcgtcagcgtcgggtgcaccgtcgacggcaaggaccccaaggacctgcagcaggagattgatgacggcgaggtcgagatcccgtccgcttgaagactagacatcgaaggggacttccattggtgctgctgaagtgttgttgttctgcatgctgtcgatgtacctttttcaagcaacgcgagccatctatttcttttgtctagctatggtagtgatatcttgtgagagacctcaatgttaccaccggatctttgtctttgttggatggagagatttaagcaccttaccacaccttttttcttttgggggtggag

SEQ ID NO: 81863 - DNA, 386 bp, Zea mays
  Clone ID: LIB3114-013-P1-K1-B6
taccgtcccggattccgggtcacccacgcgtccgcttctgtgtttgaccaaaaaaaaaaaataaaaaaaaaaaaaaaaaaacaaaaataaaaaaaaaggggggataaaataaaaagtgggaataaaaaaataaaaaattatactaaaattaataatttatttctaattatcttttttaataatataatatatcacattaattatgggctccctttttttatataccatttttattttcctctcctttccaatttttttttttttttttttcttcccttaatttaaatttcttctcctttctttttaaaactcctctttttataaaacccttattttcccccaatttttttcttttctacaaatctccccttttttctttttttttt

SEQ ID NO: 81864 - DNA, 414 bp, Zea mays
  Clone ID: LIB3114-013-P1-K1-B7
aaaaaaaaaaaaaaaaaaaaaaaaaaaaaaaaaaaaaaaaaaaaaaaaaaaaaaaaaaaaaaaaggagaaaaaaaaaaaaaagggaaaaaaaaaaaaaaaaaaaaaaaaaaaaaaaaaaaaaaaaaaaaaaaaagggccgccctttttaaaaatcccaatttttctcccccttccttccaagtataaattttttttatagggcccccaaaattaattcactttcccctttttttacaacctcggaattggaaaaccctttcttttcccaaatttaatcccttttaaaaaaatccccttttccccaattgggaaaataaaaaaaagcccccaccctatcccttttccaaaaatttcccccccttaattggaaaatggccccccccttttacccgccatttaacccccggggtttt

SEQ ID NO: 81865 - DNA, 152 bp, Zea mays
  Clone ID: LIB3114-013-P1-K1-B8
tccgaattcccggccgcccacgcgtcgcataaaaagcctaagcgtggcagggtcattccctgaccaccttcaggcaaagggggagcgatttgcggggggagagagataaataaaaaacaaaacatagtacacacacaccatgctcgcgattg

SEQ ID NO: 81866 - DNA, 276 bp, Zea mays
  Clone ID: LIB3114-013-P1-K1-C2
ctgctacgcctgcagataccgttcctgaattccctgtcgaccgacgcgtcctaaaaaaaaaaataatttataacaaaaacatataaaaaaaacttctaccgttctaaaaaaatccagggttacgtacacatacgggcgatgacataatttgtctttctttttaaacaaaccaaaattcactacccttcctttcacaaatatattttctttaaaaaccctcctaattccaaactcattccccttttatcacaaccccttttctccaaaaaccctttt

SEQ ID NO: 81867 - DNA, 62 bp, Zea mays
  Clone ID: LIB3114-013-P1-K1-C6
tcgaattaattatttttatataaccaaacacaaaaaaaaaatataaacattatattacaaaa

SEQ ID NO: 81868 - DNA, 468 bp, Zea mays
  Clone ID: LIB3114-013-P1-K1-D4
taaaaaaaaaaaaaaaaaaaaaaaaaaaaaaaataaaatatataaaataataaaaaaataaaaatggtgggtattaataataaggtagagttaaaataaatatatataaataaaaattgtccgtcccctttttaatatccatttttccttcctctttcttactaactttatacttttcttttaatatcccctaaattatttatacttcccctcttttaacaacattatatattttaaaaaccctttttttaccaaaatataattttttttacactaattcccttttttcaattttgattataaaataaaatcccttttcctatttctttttcaaaaatttctccctcttttatttcatattgtccctcctctttttactttttttttaacctccttttatttattctttttaccccctatttatcccctttcatttttttaactctccattattcctctttttttttt

SEQ ID NO: 81869 - DNA, 67 bp, Zea mays
  Clone ID: LIB3114-013-P1-K1-E1
tgatgttactattcagatttattcatggtcagctattcagaataaaaaaaaaaataaaatagggggg

SEQ ID NO: 81870 - DNA, 478 bp, Zea mays
  Clone ID: LIB3114-013-P1-K1-E11
gcctgcagtaccggtccggaattccgggtgggcggcgcgtccggagagctcttcggcttccgtccacgcgtgaagcgagagcatggacacccaggtgaagcggggtgttgtggtgaaggtggtgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctgcgctgaagccctagcgttcttggtgggctcttgtatggtctttggtgtcttggaatttgtgctatgtttgaacttctgtgaccctgttttaagagtagtaagcctggttataagattgcagttttgtttatcttgggtgaaagtgcaattggtgttgagacatgggtatccttgctatattatctataaaacgacgcatgcatt

SEQ ID NO: 81871 - DNA, 79 bp, Zea mays
  Clone ID: LIB3114-013-P1-K1-E12
taaaaaaaaataataaataaaataacaaaaaaaaaaaaaaaaaaaaaaaaaaaataaaaaagggggtgataaaataaaa

SEQ ID NO: 81872 - DNA, 215 bp, Zea mays
  unsure at all n locations
  Clone ID: LIB3114-013-P1-K1-E6
aaaaaaaaaaaaaataaaaaccaaaccatactaaataaataaattaactaacatatctataaaatacggggggcaaaaaaaataatagctgtttgcctaaaactccactccnctttctttaatattttactttcttcattatctctctcattccactcctttttaccctcatctttattattccctctccatttcttttcccactttcccctttt

SEQ ID NO: 81873 - DNA, 73 bp, Zea mays
  Clone ID: LIB3114-013-P1-K1-F11
tctaaaggatccaagcttacctacccctgcatggcgcgtgataactcttgtgggggggcacctaaattcaatt

SEQ ID NO: 81874 - DNA, 455 bp, Zea mays
  unsure at all n locations
  Clone ID: LIB3114-013-P1-K1-G4
gtgcgagcattctgacacaatcagtggaagcatcatcggggacatggacctgtgtagccccacccggggggggggctttggggggagtggtttanttcctcactaggagacatgcaagagcagtggatagcagacttttatgggtgtgcctgtgcagggtcccaatcttgggatggccaggggaaagccatcttatcaccggttggagattaacatggtagcttctggaggtacaccgaccttggcgagatgtgggtttgggcatccccagggtatttttggcagcacaacccagatccagtgttctggagttcttttggagggtcatcagctgggatcaggtaaatgtggaaatggctcaccaagaaccagtatacaggttttatgtagggagagaagaaaatgctccggttggtttagggtttagaggtttcaggtttttttcttttgttttc

SEQ ID NO: 81875 - DNA, 69 bp, Zea mays
  Clone ID: LIB3114-013-P1-K1-H4
gtctaaggaccagctacgtactcgtgcatggggggcatagctcttgtatggtggcacctaaattcaatt

SEQ ID NO: 81876 - DNA, 424 bp, Zea mays
  Clone ID: LIB3114-013-P1-K1-H5
taaggctatggatttatctccacatgaagcattatgtcatagttactctgatagggcaaagaggggaaaaataataatgggaaaaaaaaaaaaaaaaaaacaacataaaataaaaaaaataaaataaataaaaaaaataaaaaaactcttaactataataaaaaaaaaaaaaaggggcccccccttttaaagaacccaactttccttccccttccttcccaccttatattttttttttttgtccccctaaattaaattcccttccctcctttttccaccctctttacttgaaacccccttttcttccccaattattccccctttcaccaatcccccttttccccctttgtttttataccaaaaagccccccccccttcccctttcccaaatatttccctctctaatctccttatgccccccccc

SEQ ID NO: 81877 - DNA, 96 bp, Zea mays
  Clone ID: LIB3114-014-P1-K1-A11
gaattcccggggggggcccacgcgtccgaaaaaaaataatactctcaactgcactgtgtgcctgtccggtttccagacaaaggcgggggggaaccg

SEQ ID NO: 81878 - DNA, 77 bp, Zea mays
  unsure at all n locations
  Clone ID: LIB3114-014-P1-K1-A6
ttccctcctcgagccacgcttcctctcccanataacatttcttccttcatcttggctaattataaaaaataataaaa

SEQ ID NO: 81879 - DNA, 56 bp, Zea mays
  Clone ID: LIB3114-014-P1-K1-A7
ctccatttcctttccttaattcccggggcgacccacacgttcgattgaaattatac

SEQ ID NO: 81880 - DNA, 216 bp, Zea mays
  Clone ID: LIB3114-014-P1-K1-A8
aaaaaaaaaaaaaataaataaaaaaaaaaaaaaaaaaaaaaaaaaaaaaaaaaaaaaaaaggggaaaaaaaggactgtatttcataaaaaatccctatgcttatttaactttgcatatctaatatctatggttttatattggtttactctattttaaatggggtgcggttttataaaaagggacagactgttaaaacctttgttagtgggtaaatt

SEQ ID NO: 81881 - DNA, 104 bp, Zea mays
  Clone ID: LIB3114-014-P1-K1-A9
ggtacgcctgtcagtactggtccggtattccgggtggacccagcgtccgtaaaaaaaattaaaaaaaaaaaaaaaataaaaaaaaaaaaaaaaaaaaaataaaa

SEQ ID NO: 81882 - DNA, 424 bp, Zea mays
  Clone ID: LIB3114-014-P1-K1-B10
acgcctgcactacctgtccttaattcccgggtggacgccactcgtccgaaataaatataaataaattaacaaaaaatattaaaaaatccaaacttacatacacatgcggacaacataataacgtattctatattgtcacctacattttaatacactagccaaatattatacaactccgttacttttaaaaacccttactttacccaacttatatccctttcatcacatcccccttttaccagcttgcttaatatctataaagccctcacctatcttccttcccaacaattcctcatcctgatttactaatattgacgctccctatatcttttcattaatcccctcaatttttatagttacactcaaattgacctctacacttgccatatatcctaacgccctatcatttctctttcttcccttc

SEQ ID NO: 81883 - DNA, 99 bp, Zea mays
  Clone ID: LIB3114-014-P1-K1-B11
aaaaaaaaaaaaaaaaacaaaaaaaaaaaaaaaaaaaaaaaaaaaaaaaaaaaaaaaaggggggaaaaaaaaaaaaaaaaaaagaaaaaaaaaaaaaaa

SEQ ID NO: 81884 - DNA, 441 bp, Zea mays
  Clone ID: LIB3114-014-P1-K1-C1
cctccagtaccggttcggaattcccgcgcgggcaggcgtccgtattgttggacgcgttcccctcctgcacgcatcctcatctcgtcctccagatcctggaggcggatgctccttgataccttgcctcgcgagtgctctcgagctaggactgggagaaaacaacaaacccgcgttggatcctgtatcggttagtccttgccttcaaggttcatgttgttttgttttggtggtcgagcatcgcatgttctgcttctggttccagatctggagaaatttctaagtcgtcgtcgtcgtcgtcagttcggttcggagcggatctgatgcgaccatggctggaggcggcgggatctcttggtctgcagtcctgcttcacctcgatggatgatgcctctgcgctgataattattggaatcaatttcgataatttttagtagatctatg

SEQ ID NO: 81885 - DNA, 443 bp, Zea mays
  Clone ID: LIB3114-014-P1-K1-C12
taccggtcccgaattcccgggggggggcaccccttccatcctctttcccagcctttaaagaagccagggtggtggctattaaagaggcaaggtcgggggccgcttttaaaggggccggggtggtggctattaaagaagcaaggtccgccgccgctattaaagtggcaagggtggtggtggtccctgtggaaagggatattgtggcccaagaaagggtataatatggtggccgcggaccaaccaactcaatgcatgcacacttctgtcgtttccttcaatgcatgccttatcaatatatcagggaaaatacgagcattttatatgttaaacacatcacatacacgtgaggactcttgttttttttcctcctcgcgacgagtttttgtgagcatcatacatcttctacatgtatcatcatagacatcattcaatatttctgctgc

SEQ ID NO: 81886 - DNA, 277 bp, Zea mays
  Clone ID: LIB3114-014-P1-K1-C4
acgcacttgaatcggggtgtgtggcggcggcgattgtcctgtaaataccaagaattccgtccctttactggctcgttcatccagaactaatgctggtagctgccctgtgttgagcggcagctctgcttgttctagaagcttctgagaacatgtgtgggctatgttttccatgagattgtaagatgtgaggtggagccgctagaacacttagcgtgcgttttactgacagtgtggagtgctgctccttagttggaatagaaaaatgcaatttggtggc

SEQ ID NO: 81887 - DNA, 473 bp, Zea mays
  Clone ID: LIB3114-014-P1-K1-C7
gcctgcagtaccgttcctgaattccctggtcgacgccactcgtccgaaaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaatataataatcattaaatttatggggcccccttttttaatttcccaactttccttcccctctcttccacctttttttttttttttttttgccccctaattttatttcctcgcccctttttttccccctttttacttggaaaacccttggtttcccccaatttttttcttttgaaaaaattccccttttcccaattttgttttttaaaaaaaagcccccccccttttccctttccaaactttttcccaccttatttgaatattggcccccccctttttccttttttttttccccgtcgtttttttt

SEQ ID NO: 81888 - DNA, 414 bp, Zea mays
  Clone ID: LIB3114-014-P1-K1-D4
gacttagttctatatcgcgctgtaaaggcctgttgttcttgtgtgtgtatccctttttgaggggatgatcgtagagatggaagatgacttaccatgacaattttcctatacctttataacttcaaatttttttaaaaaaaaaaaaaaatataaaaaaaaaaaataaaaaaaaaaaaaaaaaaaaaaaaaaaaaaaaaataaaaaaaataaaaaaaaaagggggggccgttttaaaggatccaagcttacttacccgtgcttgcaacgtaatattttttttatagtggcacctaaattaaattcactggccgtctttttacaactttttaactggaaaaaccctggctttacccaattaaatcgccttttagaacatcccctttttgccaattggctttaatagcaaaaaggccc

SEQ ID NO: 81889 - DNA, 176 bp, Zea mays
  Clone ID: LIB3114-014-P1-K1-D5
ataaaaaaaaaatattaaaaaaaaataaataaatataaaaaaaaaaaaaaaaaaaaattagggggaggggattttataaatcttaaaatcatggccctcctctctataggatccaatcttacgtacccttgcttgcgacgttatacttcatttattgggcaacctaaattaaatca

SEQ ID NO: 81890 - DNA, 109 bp, Zea mays
  Clone ID: LIB3114-014-P1-K1-F3
ctgcagtaccggtcctgaattcccggggcgacgcacgcgtccggactagttcttgtcgcttcgggttaaaaaaaaaaaaaaaaaaaaaaaaaaaaaaaaaagggggggg

SEQ ID NO: 81891 - DNA, 308 bp, Zea mays
  Clone ID: LIB3114-014-P1-K1-F6
acgcgtccgtctgaaagaaggcgccgtccgcaccattttaaccgcctgggcgccgcctttctatgtcagtgtgctatgttttcccagtccgcgagggttgtaatctgttgttgctgggagatgcgacagcaatgtaagctacaagtctaactgtgtttgacatatgtttaggcctcgttcggttggcctggaacggccctattccatccggatatatttggtcaggattgaaaccggaaacaactaataatggttgttcggttatgtctaactcataataaaaccagattgaaaacaggtcatttcaa

SEQ ID NO: 81892 - DNA, 83 bp, Zea mays
  Clone ID: LIB3114-014-P1-K1-F7
ccggattccgggggggaggcacgcgtccgcacgccttgccgggtgtgcaccgacgaaaccagcgacagcagcacagagacgaa

SEQ ID NO: 81893 - DNA, 352 bp, Zea mays
  Clone ID: LIB3114-014-P1-K1-G12
aataaggacggatgggtgcgtgcgtttgtgtagagcagagaaatgggcgcgggggaatggtgcgtcgtcctctcctcttcttcggtagaggaggaaccgaggcagggagggtttatttcatctgtggatttttttttttgtattattattagtaaattatagtagtaccactattatcacgacgatgatgggcgggatgagatgttctgtagcagcagggaagggggaggggggatgatgtgacctgttttccaaggattgttgcttcccttttttttcttcctctgagcctttggtctgcccaagggactaaaacttctcccttggtcaatttactaagtgttgataataa

SEQ ID NO: 81894 - DNA, 295 bp, Zea mays
  Clone ID: LIB3114-014-P1-K1-G3
taataaatatataattaaaaaaaaaaaaaaaaataataatataaccaataaaaaaaaaaaaaagaataacaatcaaataacttaaaaaaaacatatcctttttttattatctcataattataattcttcgacctctctttttccaactttttttctaaaaaaaacctttcctctcccctattttatcccttttcatcccctccccctttcaccattttctttttttatataaaacccctatacctttcccccttcccttcttttccccatcctttatgttaaaaccccccccccc

SEQ ID NO: 81895 - DNA, 159 bp, Zea mays
  unsure at all n locations
  Clone ID: LIB3114-014-P1-K1-G7
cttctcttctcnntttnttagggggggcgccctttcggactctttctatatcgctagcggtcgctctagaatatccaagcttacattcacgtgcgggcgacgtattttattgctgtttagtctctccttatttcaattcactgtccgttgttttacaac

SEQ ID NO: 81896 - DNA, 382 bp, Zea mays
  Clone ID: LIB3114-014-P1-K1-H10
tctcgagcaagccggaggcggaggggatgaagacgttcgacccgtggccggtctttttccgccgggagtggaagcgcaactggcccttcctcacgggtttcgccatcaccggattcatcatcacgaagatgacgtccaacttcaccgaggaggacctcaagaactccaagttcgtccaggaacacaagaagaagcactgacgaaccaggtgaaggagttgtcagaaacgcatgtttggccagccagttctgttatgcttttgaatgaaaaatttagacccctctttctcgtttccttaatcgaaatgcttgaactctatgttccatttgtaatgtaataagaggcaaatgaattgaaccaacagcaatcaacttctgattga

SEQ ID NO: 81897 - DNA, 202 bp, Zea mays
  Clone ID: LIB3114-014-P1-K1-H9
gggtaataaatctatacttacactctaaaaaaaaaaaaaaaaaaaaaaaaaaaaaaaaaggagaaaaaaaaaaaaataaaaaaaaaaaatattaaaaaaaaaaaataatattctaattaaaaaaaaaaataatattaatcattcaaaaatgaaaaaaattttatatatatttaccaaaataaaatccttgccatattaaaaa

SEQ ID NO: 81898 - DNA, 174 bp, Zea mays
  Clone ID: LIB3114-019-P1-K1-A9
aaaaaaaaaaaaaaaaaaaaaaaaataaaaaaaaaaaaaaaaaaaaaaaaaaaaaaaaaaaaaagggaaaaaataaaaataatagatgattgggcggcctcttttaaagatccaagttttcctacgcgggcatgcgacggcatttctcttttttagggccacctaaataaattt

SEQ ID NO: 81899 - DNA, 343 bp, Zea mays
  Clone ID: LIB3114-019-P1-K1-B10
aacaaaaaaaactacaagaggaggtggcaaaaaaaacaaaaaaaggcaaccagatgcagaagatacggaaacatacaacggggagctgggggaactgagcggtggtgcccgcgcggccaagttatactgtccggtgccgggatgtctaccctattccagagggtttatctgcgttcgtgacgtgtttgctgttggccaacagtgtttttgtttgcagggtcgttctatgtcagatgtcagtgctgtaatcattctctaactcaacagaaccctgcatgaaaaatgttactctcccgattgatgaattttgacacccgggtcaggcttttttctcagtaaatca

SEQ ID NO: 81900 - DNA, 80 bp, Zea mays
  Clone ID: LIB3114-019-P1-K1-B3
accgttccttaattcccgtttcgacccacgcttccctaaaaattattacaaaattttacaaaaaaaacaactaaaaacct

SEQ ID NO: 81901 - DNA, 83 bp, Zea mays
  Clone ID: LIB3114-019-P1-K1-B8
ctgcagtaccgttcctcattcccggtccgacccacccttcctgagcacattaccactgtccgtgcaatgatggacatctacct

SEQ ID NO: 81902 - DNA, 343 bp, Zea mays
  Clone ID: LIB3114-019-P1-K1-B9
ggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaagg

SEQ ID NO: 81903 - DNA, 78 bp, Zea mays
  Clone ID: LIB3114-019-P1-K1-C1
ccgaccggcggcggctccggtgggggcggcggcggttacggcggtggcaaccgtggcggcgggggcggcaactccgac

SEQ ID NO: 81904 - DNA, 298 bp, Zea mays
  Clone ID: LIB3114-019-P1-K1-C10
cccacgcgtccgggaccctgtccatggtgccattgaggtctgcgccgagctgaggcccaccgtcgacatctctgtgcctgccaacgccgactttgtgcgcccggagctccggcagtcttcctagattgaggcagtgagcggagagggagagggagagagaaagagaggatttcgtgtcccgagttagaacagagtgctgtatgttttgtgcgactgtttgtaagtcaagtctgaactgtgaacctatgtttgcttctatcagaggacccggagaaagcctgggcatctgtttccggaa

SEQ ID NO: 81905 - DNA, 81 bp, Zea mays
  Clone ID: LIB3114-019-P1-K1-C11
aaaaaaaaaaataaacacattaacaaaattccataattttaaaaaaaaaaacaaaaaaaaaagagggaacataattaaaaa

SEQ ID NO: 81906 - DNA, 385 bp, Zea mays
  Clone ID: LIB3114-019-P1-K1-C12
gtggcggcggctacggtggcggcggcggctacggtggtggcggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 81907 - DNA, 444 bp, Zea mays
  Clone ID: LIB3114-019-P1-K1-C9
aaataaaaaaaaaaaaaaaaaaaaaataaaaaaaaattaaaaaaaaaaaaaaaaaaaaaaaaaagaaaaataaataaaaaaaggggggggccctctatagagtccccattttcacacccgcgcgcgcgccattttatatcttttatatgggcccccatatataaaattctggccccgtctttacacaaccttgactcggaaaaccctcgcgcatccccaaattaaatccctttacaacacccccctttttccccatgtggtataatagaaaagggccccacccatctccctttccaacacttttccacccccattatgtattgggacccccccctctttgtctcatattacgcgccgggtgtgtggggtttcccccccatttacaccttctcttttcattgccccatagcccccgcctttttactttttttcctttttttttcg

SEQ ID NO: 81908 - DNA, 75 bp, Zea mays
  Clone ID: LIB3114-019-P1-K1-D1
cctgcagtacccgtcccgaattccctggtcgacccacgccttccaaaaaataaaatatttaataacctaaataaa

SEQ ID NO: 81909 - DNA, 383 bp, Zea mays
  unsure at all n locations
  Clone ID: LIB3114-019-P1-K1-D2
cgcctgcagtaccgnnccgtaattcccgtgtcgaccgacgcgtccatactcaaggactactagatccactactggatggggctcgagctctactacaactaggcgccctgaccccaaccgtgccctgatgtgaggttaatccgaattctgaagtcatgggtgcgcttccagtcacagcgtctttagctaacaagctcgcatacatataggcaacttgagtgagctatgtagtacggatatggatgtgtggcaaactgccaatgactattgacatccttgcatatattgacatgtgacaaggatcaacctgcaaaactggtgccctgctactcgcagaccttattattttaaataacacaggtggtgtgtttttcaattatgtg

SEQ ID NO: 81910 - DNA, 190 bp, Zea mays
  Clone ID: LIB3114-019-P1-K1-D5
taaaaaaaataaaatatataatattctaataattattttttaaaaattaataaaaaatattaatagagtggataataaaatatatggggggggcccctctaaattttccatccttacctccccttccttcctacatacaacctcttctataaagttacctaaaatcaatacactgcccatctttttacac

SEQ ID NO: 81911 - DNA, 240 bp, Zea mays
  Clone ID: LIB3114-019-P1-K1-D9
gaacaatgatacatgatgattgttgcgttgtactggtggtaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaataataaaaaaaataaaaaaaatatatataaaataaaaaaaaaataaaaatttattataaaaaagggggttgcccaaaaaaaaaaaatatttataaatattt

SEQ ID NO: 81912 - DNA, 353 bp, Zea mays
  Clone ID: LIB3114-019-P1-K1-E11
aaatatatttattttttaatgtaataaattttttaaattaaaaaataaaaaacaaattaaaaaagaaaaaaaaggactttcgatgtaggggaataaataggggcggccgcttttttggatccaaacttcctttcgtttgggtgcccctgtctttatcttactttggggccgcctatatcaatttaatttgccaaaacttttataatttccaaactgtttacaccttggggcctccccacttattcctctttctgtatttcccctttttgcccagcttgtttatttttataaaggcccgccccttttttctttccaaacatttgcccctctttttttgccatttgtcccccccc

SEQ ID NO: 81913 - DNA, 429 bp, Zea mays
  Clone ID: LIB3114-019-P1-K1-E8
accactcgtccggggggaggctacggcggtggtcgtggaggctacagcggctgtgggggatacggtggtgcaaaccgtggggggggctacggcaacaacgacgggaactggaggaactgagcggtggggtccgctgaggcctagttatcttgttcgcttctgctaccgtgttcaccctagtctaaagggggtttatcttcgtctgaggtcgtctcgtgtccgtatgtttcgtttcgtgttctttgttgttgttgcccatctatgtttttgaccgcaagctcgctcctgtgattgttgtagtgatgtctacattcgtcaaaaataaataaaaaagggcgggctgtctagaagatccaagcttactttcgcgtgcatgcaacgtcatagctctgctatagtgattcctaaaatcaaatcattggccggtgt

SEQ ID NO: 81914 - DNA, 287 bp, Zea mays
  Clone ID: LIB3114-019-P1-K1-E9
gatgtaacttcctctaacttggtgccatgtggactggagtcaccgatgtgtgctgccaagtgtctggcccaaccgttgaacacgtggagagatgctctccatatctttagaggaggatataaggtgatttgatgattaaaaaaaataaacaaattaaataaaataaaaaataaataaaaattttaaaaaattaaataaaaaaataataaaaaaaaaaaatatatataattaaatataaataaaaaaaaaaaagggggggccgttttagagaatccaagtttacttcc

SEQ ID NO: 81915 - DNA, 168 bp, Zea mays
  Clone ID: LIB3114-019-P1-K1-F3
ttaaaaaaaataaaattatccaaaaattaaaaaaaattataatacaaaatatcaaaataaatacgagaggatgatcacaaaaatagtgtggtgggatattcaaatatgaatacattaaatttaaatctgggtggccgtcttaaataatctttccctatcttttttaaa

SEQ ID NO: 81916 - DNA, 63 bp, Zea mays
  Clone ID: LIB3114-019-P1-K1-F5
caataaaaaaaaataaaaaaatataaaaaatataaaactacctcaaaaaaaaaaaacataatc

SEQ ID NO: 81917 - DNA, 248 bp, Zea mays
  Clone ID: LIB3114-019-P1-K1-G12
cctgcagtaccagtcctttattcccggatcgtcccacacgtctcgtcttattctttattcatgcctcatcctcatattcatgtgaggcctcataggctttcaggatggtctacatctcacagaggcggagggaaattattctttatgagatcatggttcgtacactctaggcgcaccgacattgcgagttttatggccacacatgagggactcttatactactgttgatttatactccattattaact

SEQ ID NO: 81918 - DNA, 228 bp, Zea mays
  Clone ID: LIB3114-019-P1-K1-G4
ttcttccgtctgtgttcaagaaggcaatttcttcgtctccagttcgtgttgtgcgatatatattgtagggaaattgtagaggcatggttggcccggcatatattatttcggccgagtatggtgtgattctggtggtaaaatagtgacattaataggtgtgtttattgtttccgggtggagtacatagtatataactatatggagtgtttaggtttaataaatctcttc

SEQ ID NO: 81919 - DNA, 66 bp, Zea mays
  unsure at all n locations
  Clone ID: LIB3114-019-P1-K1-G6
atacgctgtacccgcagtcccntcctaattcccggtccgcccctcgtcctnactatttctatatca

SEQ ID NO: 81920 - DNA, 54 bp, Zea mays
  Clone ID: LIB3114-019-P1-K1-H1
aaaaaaaattaaaaaaatatatataatccaaaaaaaaaaaaataaaaaaaaaca

SEQ ID NO: 81921 - DNA, 68 bp, Zea mays
  Clone ID: LIB3114-019-P1-K1-H3
cgtatataaataaaaaatataactaaaaaaaaataaaaaaaaaaataaaaaaaaaaaggttaaacaaa

SEQ ID NO: 81922 - DNA, 108 bp, Zea mays
  Clone ID: LIB3114-019-P1-K1-H4
gactagttcgagatgcttgtttcaaaaaaaaaaaaattaaaaaaattataaaaataaatatatggatgggaattaaaaaaaaatgtgggaggagtaagaatatttggg

SEQ ID NO: 81923 - DNA, 185 bp, Zea mays
  Clone ID: LIB3114-019-P1-K1-H8
gaatgctttctgcccgtgaaagtaaacttgaaactgcttattatgagtgaaatgatgatgttatttcccttgcaaaaaaaaaaaaggaaaaaataaaaaaaaaatatataaaaaaaaaacataagggctataattttataaatatttatgttgtacttatgctggttatttaataaatatttttt

SEQ ID NO: 81924 - DNA, 118 bp, Zea mays
  Clone ID: LIB3114-019-P1-K1-H9
aagggcaaactaggggctaatgtaaattctcgggtgcaggagaaaggatgcatcttgtagctacctgcatccttgatctctgcagcaagaatagggtttaaaattctcttgttatatc

SEQ ID NO: 81925 - DNA, 342 bp, Zea mays
  Clone ID: LIB3114-020-P1-K1-A11
agctagcggtggtcatgaatcacgatctaaatgttttttcacaatatgttacagtgcgttaataattttagttgaaaaatgaataaaaatatagctcgatcctaatcagattcgatccttaaattttgtagtgtaaaatttatgagcacattaccatccctaatgatagctgcattcacgcttctaggacatgtgttgccacgaatgccttttcagcatctatctagattgtagcacgtgacatgtcgctaataagtgacataaataaccatttgctggtatgctgtatatgttggtctcgtggatggagcgctctaaagattatattctacgtgctcgaat

SEQ ID NO: 81926 - DNA, 404 bp, Zea mays
  Clone ID: LIB3114-020-P1-K1-A5
gcctgcggtaccggtccggaattcccgtttcgccggcgcgtgcgggtgtatggagccagtagaagaggttgtctgagaataagatcgtcgatggcacatattagatgagcttggattgcaagagagtggtgtgtttgtgcatagtgttttgacatatgagatgcgttggtcttttctttttttttctttttcttttttgtatatagtgagtactcctgccgcctcgcaacaccgggctcgatctcggccgttacctgatggttggtggtgagtgtgcttggcatcgcctgtgttctgtctttgccgctgtaccattttggagacgcttaccataatatgaacagctgtgatatgatatcgctacagatatatgcataaataacacctgatagtctgcttcagta

SEQ ID NO: 81927 - DNA, 294 bp, Zea mays
  Clone ID: LIB3114-020-P1-K1-A6
atggagccagtagaagaggttgtctgagaataagatcgtctatggcacatattatagagctgggattgcaagagagaggcgagtgactgcatattgttttaccatatcataaacgggaatctttccttaatttttctttttctttagtgtatatagttagtactcctgccgcctttcaacaccttgctcaatctcggccgttacctcattgctactgttgactatactttacatcacctgtactctgcctttaccgctccaccattttcgatacgcttactatattattaacag

SEQ ID NO: 81928 - DNA, 258 bp, Zea mays
  Clone ID: LIB3114-020-P1-K1-B11
cccccccctttaaaaatcccaattttcctccccccttcttcccaccttttacctttttttttatgccccccaaattccatcccccccccccctttttccccccttctcccttaaaaccccctcccttccccccccttaatcccttttcccccactccccttttttcccttttgttaaataccaaaaaccccccccccccccccccttcccaccatttcccccccctcatttcctaatggcccccccccttttcccccc

SEQ ID NO: 81929 - DNA, 526 bp, Zea mays
  unsure at all n locations
  Clone ID: LIB3114-020-P1-K1-B12
ttcccgggtcgacccactcgttctaaaaaaaataatttaattaaatttttaaattattaaattttaaattttttttttttaggagaaagggttttttttggagagggggaatgtaatttaatttaatttttaaagggggtaaaacaaatttattttggttnctctttgggttctttcattttaaaggttttttcttaattctcattttttaatttaattaccttcgctttttttttttttttccgcttgtttttaccatttttttctctcaaaactttttttctttataggaactttctttttttttttattattataatttttttttcaagtttggcaaattaccaaatttctctataattttttcattttcttctaacaattttaaaattttttctttttctaaaaggcttcttttctcttttagttgtcctttttttccccttcctttttatccaaattttatcttcctttttttcccgtttttaatttttttaatttcttttttttctccttttcttttttt

SEQ ID NO: 81930 - DNA, 414 bp, Zea mays
  Clone ID: LIB3114-020-P1-K1-C7
gaatttcccgggcgacgcaccccttcctattaattcaccagttccttaaagaatggaataaggtttccactatttatttttcgggagatgaggccttataaggcatggggaccgacccaattgccaagcaaaattttcttattattttaaaattcaataatattggcccccccttataaacccttattttatagacccatttaaccaaacaatttcttttttttaacttcactttaattactattctttccccccttttaaaaaatatttcaatttaaaaaacctttattttccccaattttttattttttaaaaaaaaacccctttttcccaattcgtaaataacaaagaaactcactctttttcccttttcaaaaaattttcaaacttaaatggcgaattggcccccccttt

SEQ ID NO: 81931 - DNA, 132 bp, Zea mays
  Clone ID: LIB3114-020-P1-K1-D10
ttttacgcctgccagtaccggtccttaattcccgagtcgacccactcgtcctcccactcgtctctaaaaaaaaaaaaatttttttaaatttttaaaattatattttttaaggaaaaggattctttttaaaaa

SEQ ID NO: 81932 - DNA, 267 bp, Zea mays
  unsure at all n locations
  Clone ID: LIB3114-020-P1-K1-D3
tcaaaaaaaaaaaaaactaaatctaaaacataaaaattttaatttaacaaaaaaaaaattttttagaaaaaagaaaattcaaaaaaacctcgcactctctncttttttcaacttatattaactctcctccctccttttttaaatatcccacttaattccttgccttaccctctttttcctttttttaactttacaaaatttaaattctctccccttattttaacaactctttatttcacaaacctccattttttccaattttatata

SEQ ID NO: 81933 - DNA, 451 bp, Zea mays
  unsure at all n locations
  Clone ID: LIB3114-020-P1-K1-D5
taaaaaaaaaaaaaaaaataaaataaaaataaaaataaaaaataaaaaaattaaaaatcttacatttctcaaagaataagacgtcataactcttcaaaaaaagganccnaaaaggggctccctttttaaaaaatccacaacttacttccccttcaaaacccccccattacccaacttaatcccctcacaacacatacccctttccccgcttttctacaactttttaacttgaaaacccctttcatcccccaacttaatcacctccctccccttccccttttcccccccttgcaaaaaaacaaaaaaccccccccctttctcctttccaaacaattcccccccctaaattttaataaacccccccccttaccattccattaaccccccccctttttatggttccccccacctttaccctttcattttccacccccctaacccccccttcttt

SEQ ID NO: 81934 - DNA, 89 bp, Zea mays
  Clone ID: LIB3114-020-P1-K1-D6
acctaaattcaattcacttgccgtttttttacaactttttttttttaaaaatttctttccttaccctaatttattttctttcaatacat

SEQ ID NO: 81935 - DNA, 213 bp, Zea mays
  unsure at all n locations
  Clone ID: LIB3114-020-P1-K1-D7
tttacgcctgcaagtactcatccttaattgccaagaagacgcacgcgtcccactantactanttctcgagcgcccgctctctatatacaaacttacatatctcaaagagccgaatgcctaacaaatcaaagtatgtctctctaaactcaatatacaatccactccttttacaacatacatctcaattaaaacccaaaacccactcaacacctt

SEQ ID NO: 81936 - DNA, 491 bp, Zea mays
  Clone ID: LIB3114-020-P1-K1-D9
ccttaattcccagagtcaacccactcgtcctaattaaaataaaaaaaaaaaaaaaaaaccttttaaatttccccaccttcacctcccaaagaataagaattttttaaaaaaaaaagaccccccccttcaatatctttcccttctcctacctactcatacctcttttaatttccctcaatttttttttacttcataaccctaatttccccccctcttttaattttccattttcctccccttccccctctccccatttcccttctttttttatctcccccaactttattttcctccccctttttttacccccctccctccttaaaacccctcccccccccccctttaaaccccttctcaaccattcccttttttcccatttcttttttaataaaaaatccccccccctccccctcttccaacctttttcccccccttatttccttttttccccccccccttacccccccttttaccccccctttttttttttt

SEQ ID NO: 81937 - DNA, 142 bp, Zea mays
  Clone ID: LIB3114-020-P1-K1-E2
tataaaaataaaaaactaaattttaaatcaaaaacaaaaaaaattttttctttttttttttttaggggcaaggttacttacgcgtgcaggccacgtctttcctcttttataacgtctcctaaattcaatttacttgcccccc

SEQ ID NO: 81938 - DNA, 209 bp, Zea mays
  unsure at all n locations
  Clone ID: LIB3114-020-P1-K1-E3
aaaaatntnaagaaaaagaaaaatttgggcggaggtgggctancccttctaaccacacctttctccctataacagccctgtgaccggaccaaccccattcactagagggcataaaaggcctaccctttcctacccaaaaaaacaaaaaaacattttttaaagccggcccccctaaaattaaaccacctcgtatacatctttagaaacca

SEQ ID NO: 81939 - DNA, 411 bp, Zea mays
  Clone ID: LIB3114-020-P1-K1-E5
tacccctccccaattcccgggtcgaccgcacgcgtgctaactaaatataaataaaaaatctaccactctaaaaaaaaccaatcttacatactcttccttacgacaaagaacctcttttaaaaaggcacctctattcaattcactttccctcgttcttcaacctcttcactactaaaaccctctctttacccaacttaatccccttacaccacatatgacgttggctaaataaaatattccccaagaagcccccaccgattaccccttttaacaacttctcaacctccataaccaataataccccccctgttaccacacattaatcaccacatcccctttccttactcccatcataaccgatacactttctaaccccctaataacccctccttttaatctcttcccttcctt

SEQ ID NO: 81940 - DNA, 378 bp, Zea mays
  Clone ID: LIB3114-020-P1-K1-F1
accggtccttaattcctcattcgacccacgcgtgctaaataaaaatttttttttaaataaaaaaaaaaaaaattttaaaaattttaatattttaaattttcaaggtttaagaatttttttaaaaaaaaaaaaaggtcctctaacggggctccctttttttaaattccaactttctttcccttgctttctcttttttaattcttttttattcccccttaatatttaattctttttccctttttttacaacaccttatttattaaaaccctttttttccccaacttatttttttttcaacaatttcccttttttccaatttatttattacccaaaaaacccctcccatttaccttttccaaaatttttacacccttaatt

SEQ ID NO: 81941 - DNA, 379 bp, Zea mays
  Clone ID: LIB3114-020-P1-K1-F11
gtaccggtccttaattcccgagtcgacccactcttccttattaataatttttttaaatataaaaaaaaattcaaatttacaaacaaattttttaaaggataaggtttttttttaaaaggaggacgggaattctattttactttcccttttattttcaatattttaactaaaaaaaaaagggccccccctttttaaaaatcccaattttcttcccccctccttccccctttttactttttttttattcccccctaatttaatttccttcccccccttttcccccccctttccttataaaaaccctttccttcccccattttattttttttcaaaaaaattccttttttccccttttgtatatttccaaaaaccccccccc

SEQ ID NO: 81942 - DNA, 502 bp, Zea mays
  Clone ID: LIB3114-020-P1-K1-F2
gcctgcaggtaccggtccgaattcccggtcgacggcgcgtgcgcgcgcatttggtgataaactcttgaagcagtatgttgtcgctgaccctgaaatcaaggaggaggtggtggacagctcccttgaattcctcatccttgctagtgatggactctgggatgttgtcactaatgaggaagctgttgccatggtcaagcctattcaggacccccaggaagcagcaaacaagcttctcgaagaagcgtcccgaaggggaagctctgataacatcaccgttgtcatcgtccgcttcctatatggaactaccggtgataaatcaggcgcagacaaagagaccaccaatgaccaaaactcctaattacctcctgtagggatccctcatgcgtgtgttttcttctggctggtgtatctgatgctcaaagtagatgctccgtgtgtcttccgctgctgttccgcaaggaaactgactcccccgaccgtcgtcgtgatgctgcccgctcat

SEQ ID NO: 81943 - DNA, 71 bp, Zea mays
  unsure at all n locations
  Clone ID: LIB3114-020-P1-K1-F4
taggaggaggaaccttacgtacgcgggcatgcgacctccttnctctttttttttttcacctaaattcaatt

SEQ ID NO: 81944 - DNA, 225 bp, Zea mays
  Clone ID: LIB3114-020-P1-K1-G2
acgcctgcagtaccggtcctgaattcccttgtcgaccgacgcgtcctaaataatatttttttttaaaaaaaaaacaattaaaaaaaaaaaatttaaaatccaaattttcaaaagaaaggaattcaaaaaaaaaaaaagaaaggggccccccttctaaaggctccaagctttcttacccgtccatgctacttcaaatctcttatatagtttcacctaaattcaatt

SEQ ID NO: 81945 - DNA, 437 bp, Zea mays
  unsure at all n locations
  Clone ID: LIB3114-020-P1-K1-G3
taaataaaaataaaatttaaaaaaaaactcttttaaaaattacaattttacaaatctcattcttaaaggataaaaatctttaaaaaaaaaacaccctaaattcaattcactttcccctcattttacaaccacaaaaactaataaaacgccccccctttctaaaattcccaattttccctccccatcccccccacnttatatttctttttattggccccccaatttcatttccctcccccctttttccccccctttcactttaaaaaccccttccttcccccaatttaatcccttttcaccacatcccttttttccccttttcccaaaaaccaaaaaccccccccccatttccctttcccaccattttcccaccctaattaccaaattaccccccccctttacctcccctttaacccccccgttttttttttttcccc

SEQ ID NO: 81946 - DNA, 389 bp, Zea mays
  unsure at all n locations
  Clone ID: LIB3114-020-P1-K1-H10
aaaaataccttctaattttaaaaaaatcccaaactttacacaaccctatcatttaagaaacaaggccttttttaaaaaaaaaaccaaaanttccntccacttcccctctttttacaacttactatctatcaatacaccttcctttcctaacttaaatttcttacaataaatccttgtttttccctcttacatcatcaaattaaacacccccctccttaccccttcttacatattctatatcttactctacatttccacaccccccttatcttcacattaacccccacccttaaatccctttcattacccaccttaatatacactttaaaaatccccctttctccatcttttcccttaattaaaaaaatttttctccaaccccctttcca

SEQ ID NO: 81947 - DNA, 393 bp, Zea mays
  Clone ID: LIB3114-021-P1-K1-A1
ccaatcctgttgcgccacctggaagacgcaaacaactctgttggacagaaaaagaagtagctattttgagggtaatcattctttggatgtaaattttcattgttgaaacactgtctctagcgctggcttttcccaggccaggtttgtagtgtgtaattatgtctcgcctggccatgagtattatacttttttactgtgatgatccaggatggggtggcaaaattctctccacataataatggtaaaataccatggacccagatctgcatatgggccgcggggttcaaggacgcgcctgccatgtgatttgggctcaagtggagaacatggagaggaagaagtgggcaggctactgatgctggcaatcttaccacaggcacacacacacacaca

SEQ ID NO: 81948 - DNA, 121 bp, Zea mays
  unsure at all n locations
  Clone ID: LIB3114-021-P1-K1-A10
taaaaaaaaatacatttctaaataatccaaacataacttacccactctcaagagacnttttaaaaaaaagaatagagtcacctaactccctttttctggtctcttttttacatcctctatt

SEQ ID NO: 81949 - DNA, 177 bp, Zea mays
  Clone ID: LIB3114-021-P1-K1-A2
taaaaaaacattaaaattttttttaaaacaaaaacaaaccattctagaaaatacaagcttacgggttttttaaagggaaaaaaaagggcttttgtttaatgtcacctaaacttccatttgactggccgcgcgttttacatcctcgttcatgttagtaccctgtttttatgtccggcc

SEQ ID NO: 81950 - DNA, 379 bp, Zea mays
  Clone ID: LIB3114-021-P1-K1-A3
cccctgggaagaaatcccatgctatcgatgctttctcacatgctctgtaagccattctagcagtcatagctgacaatgctggtttggatagcgctgatttgatctctcagctacgagctgagcaccacaaagagaactccactgctggaattgatgtcatcacaggcactgttgggggcatgcaaaagctagggcttcaaggaggcgttccaagtgaagcaagccattcttctggctgcacaaaagcttgcgagatgatcctcagggtcgatgagatcataacctgtgccccgcgcagaacagaggataggatgtgatattacacgctgtttctcgatgtagcgggatgctcatcaccctagttttgaggggtattatg

SEQ ID NO: 81951 - DNA, 110 bp, Zea mays
  Clone ID: LIB3114-021-P1-K1-A6
ggccccgttcggtttggcctgaacgacctggaatacagcatattccagctgaaattatgtcacttggattaaaactggatcaatcctaaatatctgttcggatagattaa

SEQ ID NO: 81952 - DNA, 259 bp, Zea mays
  Clone ID: LIB3114-021-P1-K1-A8
aactaatactatatatgcttcttcacatgctctgcaagccattccaacaatcatacctgacaatgctgagtttagatagcactttattaaaactctaaaataaggggctgcccttctaaaagagcaacgctattgatcgcattgatgccatcacatacactttttgagacatgcaaaagctcatgattcaagagtcgttcaaagagaagcagaccattcatctgtctgcaacacacgctgctcaatatgcttcgcaaaa

SEQ ID NO: 81953 - DNA, 136 bp, Zea mays
  Clone ID: LIB3114-021-P1-K1-A9
attcccggggcgcggacgcgttcgcccctgcgtaaaaatccctttcttatattccgttttttccatgcttttcaaaccattccgagagtctttcgagggaggggtgggttcgattgcgcttattttatctctcatt

SEQ ID NO: 81954 - DNA, 236 bp, Zea mays
  unsure at all n locations
  Clone ID: LIB3114-021-P1-K1-B1
tcccgggtcgacccactcgtcctaaaaaaaaaaattaataattttaaaaaaaaaaaaaaaaaaaaaaaaataaaaaaaaaataaggggaaattaaggggagttaaaaaaaaattaaaaaaaggggccccantttttagggtttcttggntttatttttnnttgcattaaaaattaaaaaattttttttattgtaatccttaaaatttttttcaatcccatccccctttccccagct

SEQ ID NO: 81955 - DNA, 151 bp, Zea mays
  Clone ID: LIB3114-021-P1-K1-B11
agcgaaacatcatttttgggctcaactggtgttaacaccgatagcagcaaagaggagaagagacacgggaaactggacagccggaagaacgaacgaatgttattcagtaaactgttgtcccacaaacgaacggaacacaactatttagact

SEQ ID NO: 81956 - DNA, 219 bp, Zea mays
  Clone ID: LIB3114-021-P1-K1-B12
tcccttttcaacccactcttctctaataaactttttttttaaaaattctttttttttcacacaaaataaaaaaagaaaatttttaagaaaacacttaaaaaataaacaaaacaaaacaaccaaattaattttatacaattaaaatattgatccactaactaccttaaacacaattttttaaactcaaaaataaaaaaaataaaatcataaggggctccc

SEQ ID NO: 81957 - DNA, 429 bp, Zea mays
  Clone ID: LIB3114-021-P1-K1-B5
caactccctgctagtcgcatccgaccccgagggcagggtgccgctcttctgggggatcaccgccgacggctgcgtcgccttctccgacgacatcgacatgctcaaaggctcatgcggcaagtcgctcgcgccgttcccgcaaggctgcttctactccaacgccctcggagggctcaagtgctacgagaaccccaagcacaaggtcaccgctgtccccgccgacgaagaagagatctgcggtgccactttcaaggtggtggaaggctctactgtcctgacggcgctgcactgatcggtcatcagctggcggaggcgatgcgatgatgatgcagaactttgtacatgcgttggtggatggtgtgtaacatagtggctgccaacaagtcatgctcatgcaaaccgatgaatctatctctgtatcatcgatct

SEQ ID NO: 81958 - DNA, 432 bp, Zea mays
  Clone ID: LIB3114-021-P1-K1-C11
tgttgtattagagagagaaagatgatttattttatattattttggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaacggctaagaaaaaaacaaaaaaaaacaacccaaaaaaggggggcccctttaaaaaaaacaaaattaaataccccgggcaggaaaggtaaaaattttttaaaaggggccccaaaaaaaaatcaccggccccgtgtttaaaaacgggggaacggaaaaaacccgggggtaaccaaaaaaaaaggcttgggaaaaaatcccctttttcccaggggggaaaaaaaaaaaaagcccccaaccaatcccctttccaaaaaattccccacccaaaaaggaaaatagaccccccc

SEQ ID NO: 81959 - DNA, 84 bp, Zea mays
  Clone ID: LIB3114-021-P1-K1-C3
aaaattttttttttttttaatttttttaattttttaattttttttttttttttttttttagggattttttcaggaatatttatt

SEQ ID NO: 81960 - DNA, 450 bp, Zea mays
  Clone ID: LIB3114-021-P1-K1-C7
aaaaataaaaataaaaataaaaataataaataaataaataataaaatataataaaataataagagagaattttattataaaggagaaaaaatataaagagaattaacaataagagagttgccaatactaacaatacaaaaattatttaatataagtgtttacattaaaatttaaaatctactaggacattggttttaaaaacttaaatacttaaaaaaaacttgggggggggcttttttaaaggttttggataaattcttgttttgccagctttagtattttttataaagggcccaatctatatttcttatgaacagtttttaaaaactgaatgatttaataaaaacacgtctctgttacctatatattaaggttttgcggaaaatattttttattttcaaggtgaataattaaactagggtgttccctaccccccactcctaaaaattt

SEQ ID NO: 81961 - DNA, 154 bp, Zea mays
  Clone ID: LIB3114-021-P1-K1-C9
aaaaaaaaaaaaaaaaaaaaaaaaaaaaaaaaattttttctctctcttgagaatccaatctaacgtccccatgcataccactgcatacctcttcaataacctcacctaaattgaagtctcttccttcttttactactttttcctcttaaaaccc

SEQ ID NO: 81962 - DNA, 446 bp, Zea mays
  Clone ID: LIB3114-021-P1-K1-D1
gacttctgcaatcatatccatagaagtttgctcaaggacgtgaagtatgtgctcgtatggggaaccagcgcaaggcactatccacagcattgcggcctcggccatggccttaacgacgaggatgtcgtccagatagtaaagaagaaagaaaaggaggagggtgggcctaggcccgttcaaagtgcacacgaaccgcacctgaccggttttttgatgggtggaaaaaagcccaactgaaaacatattaccggtttccttaacgccttgtgatcaagttcttccaacccgattgcacacacacaggtctggggggagatcataaaatctggaactagctgagccgcggcgtgctacttgttttgtagtaccagaacagaaggggccaccgccatgtttggagtactccaccttccacaatacctacaccaatgcggcaccaccatgaa

SEQ ID NO: 81963 - DNA, 74 bp, Zea mays
  Clone ID: LIB3114-021-P1-K1-D12
ttttaaaagatccaagcttacgaacgcgtgcatgcaacgtaaaagcttttttatagggtcacctaaattaaatt

SEQ ID NO: 81964 - DNA, 301 bp, Zea mays
  unsure at all n locations
  Clone ID: LIB3114-021-P1-K1-D2
tacgcctgcagagtaccggtccataattcccgtgtcaacccactcgtcccaactagttctagattagagcttttcttccaaanaaaaaaaanaaatatatattaattaaagattttttaaaacgacgtcataacactatatataatttcactataaattaacctttactaaaaaaatttcattttaaaatcaaaaaaaaaaaaaacccaaactggggcccccccttttaaaaaacccaactttccttccccctccagctcacgtaatatcttttttacccgcacctatcaccctttccaac

SEQ ID NO: 81965 - DNA, 439 bp, Zea mays
  Clone ID: LIB3114-021-P1-K1-D4
aaaaggacccggcctttgtagcctcctcaacagagagtaggtttaaaagaaccaaacttaggtaaaacaaaagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaagaatcaaagttaacaaacccgtaaatacaacgtaaaaatttttctttagaacaactaaaaaaaaatgaattgccaatggtataaaaactttagaagtggaaaaacctcggcgtaaccaaaataaatccccttgaaaaaaatctcctttttgcaaggtggtaaaaaaacaaaaaaacccgaactaatcgccttttcaaaaaattgtcaaacctaaatggcaaaaagaacccccctttaaac

SEQ ID NO: 81966 - DNA, 429 bp, Zea mays
  Clone ID: LIB3114-021-P1-K1-D5
aaaaaaaaaaaaaaaaaaaaaaaaaaaaaaaaaaaaaaaaaataaaaaaaaacaaaaaaaaagaaaaaataaaagaaaaaaaaaaaaaaaaaaaaaaaaaaaaaacaaaaaaaaaataaaaaaacaaaaaaaataaaagccccccctctttaaaaaacccaagttttaccccccttaattccccttcaatacttttttttttttgccacctaaattaaattccttgccccccttttaaaaactttttacctgaaaaaaccctgccttaaccaaaataaattcccttaaaaaaaatcccctttttcccaattggctaaaaaacaaaaaagccccaaccaatctcctttccaaaaattttccaaccctaaatgccaaaaagaaccccccttttaccgccccataaaacccggcgttttttgtgtttccccc

SEQ ID NO: 81967 - DNA, 115 bp, Zea mays
  Clone ID: LIB3114-021-P1-K1-E2
aaaaaaaaaaaaaaaaaaaaaaaaaaaaaaaaaaaaaaaaaaaaaaaaaaaaaaaaaaaaaaggcacaaacaaagggaaaaaaaagctcttctataaagtcacctaaattcaatt

SEQ ID NO: 81968 - DNA, 96 bp, Zea mays
  Clone ID: LIB3114-021-P1-K1-E3
ttcccgtgtcgacccactcgtcctaaaaaaaaaattttttaaaaaaataaaaaaaaaaaaaaaaaaaaaaaaaatatttttttttaagagtttttt

SEQ ID NO: 81969 - DNA, 510 bp, Zea mays
  Clone ID: LIB3114-021-P1-K1-E4
tttacctgttctcctgcagtaccggtccttaattctccgtgtcgacccactcgtcctaaaaaaattttttttttaaaataaaaaaaattttttataaaaaaaattttttttataattaaaaatttttttaagaaaaaaaataaaataaatttaaaaaatttaaataaataaaaaaatatccccaattttaataatttaaaaaataaattggggcccctctttttaaaaaatcaaatttttttccccctcttttttaaaatattattttttttttttttcccccaaatttattttttttccccttttttttaaaactttttttttttaaaaaccccttgttttccccattttaattttttttaaaaaaattttttttttttcccattttttttttaaaaaaaaaacccccccccttttcttttttaaaaaattttctcccttttttttttaattagaccccccttttttccttcttttttacacccggtttttttttttttccccccccct

SEQ ID NO: 81970 - DNA, 242 bp, Zea mays
  Clone ID: LIB3114-021-P1-K1-F1
cccacgcgtccgactagttctaggctagagcctgcttcgagccttaaccctcttcctggcgcttcgatctggcttttgcctgcgtcaactttgcccccatgttttaataaacatgatgtgtgctattaattttgtcttgttcaaaaaaaaaaaaaaaaaaaaaaaaaaaaaaaaaaaaaaaaaaaaaaaaaaaaaaaaaagggggggggtataaaaaaaaaaggaaaaaatatgtattgtat

SEQ ID NO: 81971 - DNA, 150 bp, Zea mays
  Clone ID: LIB3114-021-P1-K1-F5
aaacgccaagcggtcgttatcgattcttctagatgggcaagggtaaggtatacttcgtttgtgtccgacatattatgtatttgtatcatgtatagatacgttttgttgacaacaagtgctaattataatgtataccatgtttgggaacct

SEQ ID NO: 81972 - DNA, 324 bp, Zea mays
  unsure at all n locations
  Clone ID: LIB3114-021-P1-K1-F6
aaacgatcgccggacttgggggtgcctgagaggtccgtctcctgccagccccatcatacgggcctgaacaggcggagacatcgtgaaataagagcgtcnctgatctgtgatcatcgtatttgtcattatgcacctgtagcaaccgatggactgaactgtgctggattatgctgttggatcacctgagtatgtgttacatgtcggttttgatgtgacatcctatcgtttcgatgtgttttgtggaagtgttgttgcaagatttcaacagtcacgacttggttttgatatgcagtcagcagcagctcctgagttgtgattgctcaa

SEQ ID NO: 81973 - DNA, 435 bp, Zea mays
  Clone ID: LIB3114-021-P1-K1-F8
ccggaattcccgtttcgacccactcgtcttctaattaaatttttttttttaattaaaacaaaatttttttttcaaatttagaggattttttagagaaaactttaaaacacaccaaaaaataaattttaagtccttctcttttttacctttcttttctttccctctcctctgctttttcccttccttctttcctttttttcccctcctttttctctacacttattctccttttttctccattttttttttttttaatccttttccttccctcccttatttccctataagcctttcccctcttttcctcctccctttttaccatttagccccccccttttccccctttcttatcttcttcccttcctcttttttttatttctcgtccccccatcactgtccttttccctctctgcttttcctttctctctttccctt

SEQ ID NO: 81974 - DNA, 199 bp, Zea mays
  Clone ID: LIB3114-021-P1-K1-F9
taaaaaaaaattttttattaaaaaaaaaaaaaaaaaaaaaaaaaaaaaaaaaagaaaaaaaaaaaaaaaaaaaaaaaaaaaaaaaaaaaaaaaaaaaaaaaaaaaaaaaaaaaaaggggcgccccttttaaagaatccaaatttacttacccttgcatgcaacgtaatagtttttttatagggtcacctaaattaaatt

SEQ ID NO: 81975 - DNA, 471 bp, Zea mays
  Clone ID: LIB3114-021-P1-K1-G11
caataccttctactcctgcaagtaccggtccgtaattcccgtgtcgacccactcgtccgctcaaaaaataaaatttttaaaaaaaaatataaaaaatttcatttttaaaaactcttttaaaaaaaaaaaaaaaataaaaaaaaaaactcatcttatattatattcactattcaaaattatttacaacaaaaatataaaaaaaaaaaacggcccccctttttaaaaattcccatttttttccccttcttttccacattttattttttttttattgcccccaaatttaattccccttcccacttttttccccccctgtattttaaaaacccttttttttcccaaatttaatttttttcaacaaattcccctttttcccatttggttaattacaaaaaagcccccaccctatccccttctcaaaaatttccccacctttaattgataattaccccccccttttttcccccctta

SEQ ID NO: 81976 - DNA, 209 bp, Zea mays
  unsure at all n locations
  Clone ID: LIB3114-021-P1-K1-G4
gtaccggtccgtaattcccgtgtcgacccactcgtccgtagtagtttctattcactaaacttacatctcaaaaaaaatccaatcttacatacaactttcaagctactttttaaaaaaatctataatatcacctaaaattcanttcactaaccaataattttacaacgtcttttctaataaaaccctttctttacccaacttattcgcct

SEQ ID NO: 81977 - DNA, 230 bp, Zea mays
  Clone ID: LIB3114-021-P1-K1-G5
aaaaaaaaaaaagtcaagggtaaaaaacaaaaaaaagaggggaattttaaagaggaaatgaaaaaaaaaatagagctctcccttaaggttcctaattccatcctctggctcgcgactttacagctgtaaaactggggaatcccaattgaattcacatgttagtagttttacaacttcatcactggaaaacccgtggcgtgacccacttaaaggtccttgccgaacatttt

SEQ ID NO: 81978 - DNA, 164 bp, Zea mays
  Clone ID: LIB3114-021-P1-K1-G6
aagatttctctgttatttatgcttaaacagggaccattttcatccggtcaattatttgatgaagatagacagttcacccttgtttgtttaccctcctctagattattaaataagttagaagacaaacaaacaacatatattattaatgtatgtgttttttataa

SEQ ID NO: 81979 - DNA, 362 bp, Zea mays
  Clone ID: LIB3114-021-P1-K1-G7
gagggtgggttttaattattttttaaataattttaatttaatttaaatgggggccccctttttttagttcccttttttttccccctttttttgtgtctttttcactttttttttcttgtctccttttttctttttttcggccttttttttaccacttttttttttataaatcttttttttccccatttttttttttttggagctcatcctttttttcccttgttgctttttttataggacccctcatcttttttttcttttttaattgttgcccctctttgtcgtgtgattgtgccccttttttagggcttttttccgctcggttggttttttttttccccttttttcttcctttttttttt

SEQ ID NO: 81980 - DNA, 266 bp, Zea mays
  Clone ID: LIB3114-021-P1-K1-G9
accaaggatgagaagaaggcgaagaaggctgaggtgtccaagtcccagaaggcgcatacggagggtgctgttcagaagggttccaaaggccccaagttgggtggcggcggtggcaaacgctgaaaaggaactaagtgtcattccgagacctcatcaaagccacctttgtagtaccttggttaattttgtattttatttgagagttacttgtgactcttaattttgcatctttatatattgggagaaatgatcgccgttcgttcaaa

SEQ ID NO: 81981 - DNA, 256 bp, Zea mays
  Clone ID: LIB3114-021-P1-K1-H4
tactaaatatataatattaaacaaacaatctaaacgaatccatctagtaagatccacattcaagagccctcatatgcgacgtatagaatcacctaaactcaactctctacccatcaacttactccatactttacagcgaattcactggcctaaccctgctttatcaactttcaaactatgaaacttttggcagctcccatattaacgaattagcccgaaatgctcctttttccaaatagtttattagcctaaatgc

SEQ ID NO: 81982 - DNA, 304 bp, Zea mays
  Clone ID: LIB3114-021-P1-K1-H6
aaatacaggcaagagctgctcgcgtgcgagggcgctgctattcgatagcggaggcggcggcggcggcggcggcgttcacgcccctgttactgttagtagcttaattaacttttgtgcagtctgatcaatacgtgttggcttgtttgtttgctgcttcttaatttaattcgtatgtgatgtattctgctcaccctagcaaaaaaaaaaaaaaaaatgcatcgatgccaagttgtgaatgaattgtactattcagttatttggaccggcttagtcggaatatagtgagacggagtttgttggtgtg

SEQ ID NO: 81983 - DNA, 190 bp, Zea mays
  Clone ID: LIB3114-021-P1-K1-H8
taataaacattatttcaaaaacaaaccctctaaaaatatccaaacttacgggccctttacagagggacgtaaaaaactcttctatagtatcactctaaattcggttcactttccgtcgcgtcacatcttcatccctggccataccctaccttaaccctacttaattcactctcaattcattcccctttcc

SEQ ID NO: 81984 - DNA, 398 bp, Zea mays
  Clone ID: LIB3114-024-P1-K1-A10
atccaaaccaatatttcagtgaaagccagaaagttctgcgggccaaaaaccagaaaatggagagccaatcagcaacctaaatggtattgcagctggagaaactatgcatcttcaaaaatcttaccagcaggtaagcactgaagcaatattcatccttgaagccaattatgttatcattactgattgttgaccattggcgtctacctggaatattgttgcttcctgctgttaccaaattccagctgctggcttggcctaaaaagaccaggctccagctgttagctgccatgccctacccaagtgatggcaccacactgtacactagaagtagaagtgttatctagtgctgcgaacagcagcaggtcaaatgcgtgtgtacatgtaattctccgaagaac

SEQ ID NO: 81985 - DNA, 256 bp, Zea mays
  Clone ID: LIB3114-024-P1-K1-A11
cgacgtctgtagataacatgcagtgcttgtagtacgtccacggtcgcttgcacgaatccgcgcttgaagcatcttcggagggaaatacttacatcaattcgtgcttgaggctgaatgaagaaatgagaggcttggaaagcttacctatgcaactgtatattctacggaagaatgttgattcactagatctggcttatattcaattagttcgccttccctagtcaatggaaactatcaatgaagcttcaatggcaac

SEQ ID NO: 81986 - DNA, 88 bp, Zea mays
  unsure at all n locations
  Clone ID: LIB3114-024-P1-K1-A4
gggggtgnaggggggggggaataatttttgggggggggtttatgttccggggggggggggcccctccccgcccccccctggccccccc

SEQ ID NO: 81987 - DNA, 281 bp, Zea mays
  Clone ID: LIB3114-024-P1-K1-A5
acttcttgtaggtagagggcgaggtgctggattgaatctgagcagcgagggtgccaagatgccgactggctgtgtgcgggttcactgtgtgtcatcagaagtatatgtttttttttgtgtcgggacggggctagatttgggggttcgacaactgtgtgagtgcagaaactgaaagggagttggtgggtttcttaggattaaacaaattactttggatttatgaatggagagcgttatattgatgaagtctcaactctggaaatgtctcacttgttccttac

SEQ ID NO: 81988 - DNA, 298 bp, Zea mays
  Clone ID: LIB3114-024-P1-K1-A7
cgatgatcttggaaagggtggacacgagctcaggaagagcaccggaaacgctggcggccgtgttgcttgtgggatcatcggactccagggctgaactgaaacaaatggtcgttggacttcgggggcgcctgggagtgccgtcaccagcaggctagaataacatcccgaagacatcgtgaaataataataataagagcgcctgatatgtgatcagtggtgtactcgccattaagcacctgtggcaaccgatgagctgaactgtgttggactgttggctaaaatgctgggtcggcctgac

SEQ ID NO: 81989 - DNA, 90 bp, Zea mays
  Clone ID: LIB3114-024-P1-K1-A8
taccggtccggaattcccggctacgacccacgccgttcgaaatataactagagctactgattcattagtgcaaaaggcctgcgacggttt

SEQ ID NO: 81990 - DNA, 120 bp, Zea mays
  Clone ID: LIB3114-024-P1-K1-B1
tactaattatagatcaaaaagcaaacaatataaaaaaataacaagcttacatacacatacatgcgaagtaataaatctggtatggcgtcacctaaattcttttcactggccacctgattt

SEQ ID NO: 81991 - DNA, 115 bp, Zea mays
  Clone ID: LIB3114-024-P1-K1-B11
aaaaaaacacttaataactaaaaaaaagcaaaaaattaaataaaagaaatataaaatgaaaggagaacaattttagttggtcccgcctgttagcaatgcaagtgctcgtaagtca

SEQ ID NO: 81992 - DNA, 111 bp, Zea mays
  Clone ID: LIB3114-024-P1-K1-B12
aatcgtccacttctaacttttaattgcaattccttgaattcagacttctgtgttggaatgtgaacaattttagttgtacccccctgttagcaatgcaagtgctcgtaagtc

SEQ ID NO: 81993 - DNA, 170 bp, Zea mays
  Clone ID: LIB3114-024-P1-K1-B2
aaaaaaaaaaaaaaaaaaaaaaaaaaaaaaaaaaaaaaaaaaaaacaggccaacctacacgggagtacgacgttaccggtcgggtataggctcccccttaccctttctttaggcccaccttattccatttcgtggcccggaaattcacaacgttgcccctgttaaacccc

SEQ ID NO: 81994 - DNA, 334 bp, Zea mays
  unsure at all n locations
  Clone ID: LIB3114-024-P1-K1-B3
agacgctgctgcgcctcatcgggagggcgcgcgtggaggatgccaactgctgacgccgctcgactgcaagctcgagtccatgcccgttgccgcgcatgagggcatgggacccatcatgccgctcggcgtcaagcactgacgatacacgcagcagtgcagtctctggtttgctggttaatgctggtttggttcgggttggacgaacgattagtaagtagctcgaataattagtataactgtatcggctaattttatgagtttgcgcgcgcgctgtgtggggtatacctgcgcatcgagctgnctgtcactgctgaattggctcctaaaataaaaa

SEQ ID NO: 81995 - DNA, 143 bp, Zea mays
  Clone ID: LIB3114-024-P1-K1-C10
aaataaatataaataagaaagcagacaatataatagataacaaaattacatacacatgcatgggaaataataactataaatatagagacacctaaaataaaattcactggccgtatatattacaacttggtgggctttttttg

SEQ ID NO: 81996 - DNA, 209 bp, Zea mays
  Clone ID: LIB3114-024-P1-K1-C12
aaaaataaatattctataaaaaacaaaaaaaatttacatggccgcccaacctaaaaaaaccaggattacttacacaggggtgcggacgttataaaaatattataatggtcgccctggtctctttctcctgctcgtctttctcctcctcccgactgtaaaaactctttcgttacccaatttatccgcttttcagttcatccccccttttg

SEQ ID NO: 81997 - DNA, 328 bp, Zea mays
  Clone ID: LIB3114-024-P1-K1-C3
tcctttttttttcttgttttttttttattttcctttttttattttttttttttttgttattttctcttctttacatttctcttttttccctttttattgtgcttcctttttttttttttcctcttatttctgctctttatttttttttgtgttctttcatatttattttttctttttatttttttctttgttcttttttttcgatttgttttactttttccttttatatttcttttctttgcttactttttctttattttctcctttttttttttctttttcttcctttttaaattttatcttttcttttcttctttttttttttttt

SEQ ID NO: 81998 - DNA, 226 bp, Zea mays
  Clone ID: LIB3114-024-P1-K1-C5
cccacgcgtccgaaaaaaaaaaaaaaaaaaaaataaaaaaaaaaaaaaaaaaaaaacaaaagggggggaaaaataaagggtggcgggcgcgtccataccccagtcatcgctctttttttttggcgcctatatcttttctactgcccgtcgtttttcaacgtccggactggtatatccctggcgttgcccaacttaatccccttgcacacatccctttttctccagc

SEQ ID NO: 81999 - DNA, 62 bp, Zea mays
  Clone ID: LIB3114-024-P1-K1-C6
tcggactcgttctaaaaaacaaactgtccctctttttattatccatcttaattttcacaaaa

SEQ ID NO: 82000 - DNA, 111 bp, Zea mays
  Clone ID: LIB3114-024-P1-K1-C7
ccacccgtctgtttatttctagaccgggcccggcctttttaaaggacccaaccttacttccccgggcttgcgacgtcttagttttggtttggggcaccctaattcaattca

SEQ ID NO: 82001 - DNA, 338 bp, Zea mays
  Clone ID: LIB3114-024-P1-K1-C8
aactatttctatatcgccaaactcctactgtgcttttgcagaatggagcgccaggtatcgttgtagctgcggtacgtgggggggaacagctgggacaggacccctggcgcaactccttcttctgcttcttccaggggatgatccgtagattgcgttgcgaaataagaatttgcaaggtagagatcctttcctttcatatcgcgcggtgacgcgatttagatgggcatcctttttatttttcctccatcgtttctgcacattcttttttttttgggtgctgaatagtactgtacagtttatgatttgcttggactcatgatcgagagtgttatatatac

SEQ ID NO: 82002 - DNA, 216 bp, Zea mays
  Clone ID: LIB3114-024-P1-K1-D1
aaataaaaatattaaaaaaaaaaaaaaaaaattttaaaaaaaaaaaaaaaaaaaaaaaaaggggaaaaaaaatttagggaggggggataattttttctaaagccttcttaaaatggtgcgccctcttttttggttcccctcttcctctcccccttgcttcctcctttttcccccttttttttgggcgccctattctttttccccttcttttctttt

SEQ ID NO: 82003 - DNA, 88 bp, Zea mays
  Clone ID: LIB3114-024-P1-K1-D10
tgcactttgggtactatcaggacttgtaataaatacatctctttctaccttgtaaaacttgagttctggaatgtaaagagtactttgt

SEQ ID NO: 82004 - DNA, 313 bp, Zea mays
  Clone ID: LIB3114-024-P1-K1-D11
gaggcggctacggcggtggcggtggaggctacggcggtggtcgtggaggctacggcggcggtgggggatacggtggtgcaaaccgcggcggcggctacggcaacaacgacgggaactggaggaactgagcggtggggtccgctgaggcctagttatcttgttcgcttctgctaccgtgttcaccctagtctagagggggtttatcttcgtctgtggtcgtctcgtgtccgtatgtttcgtttcgtgttcgttgttgttgttgcccatctgtgtttttgaccgcaagctcgctcctctgatgttgttagtgaaa

SEQ ID NO: 82005 - DNA, 173 bp, Zea mays
  Clone ID: LIB3114-024-P1-K1-D12
aaaaaaaaaaaaaaaaatattaaaaaaaaaatttttaaaaaaaaaaaaatattaaagcgaggggggaaaaaaaattataggaggaataaggggcggcccctttaaaagatccaagtttacttacgcgtgcatgcaacgtaatagcttttttatagtggcacctaaattaaatt

SEQ ID NO: 82006 - DNA, 169 bp, Zea mays
  Clone ID: LIB3114-024-P1-K1-D2
aaaaaaaaaaataaaaaaaaaaaaaataaaaatttaaaaaaaaaaaaaaaaaaaaagggcgggggggttaaaaaatacctaatgggttttcgcgggcttccgttcttattgtttcctgttttcgccacctgcatgcaatttactggccttttttttgcctcctctatat

SEQ ID NO: 82007 - DNA, 218 bp, Zea mays
  Clone ID: LIB3114-024-P1-K1-D5
ctgttgggggggtttctttttttattcttgcttttcttttttaacttgtgtaccggtgcgctgggttccttgtagcctattacctttttcatcaacgttcctgggtgaaaccctggctaacaaaaaaaaaaagggggggtgggaacaaacgccccccccctgccgacccggggagaaaaccttactgccaaatgtgggtcccaacaaaaaagccccac

SEQ ID NO: 82008 - DNA, 106 bp, Zea mays
  Clone ID: LIB3114-024-P1-K1-D6
ttttctcctgctttccctttccggtttttccctggtcgaccctctcgtccgttatttttaatttaattaaattagcactattttttttttaaaataatttttttta

SEQ ID NO: 82009 - DNA, 51 bp, Zea mays
  Clone ID: LIB3114-024-P1-K1-D7
aaataaaatattaaaacaaaaacaaactttattaaaaaaaacaaaacttac

SEQ ID NO: 82010 - DNA, 109 bp, Zea mays
  Clone ID: LIB3114-024-P1-K1-E11
aaataaaaataaatcagagagcggacgatcttattagataacaagcttacgtacccgtgcatgcgacgccatatttgtggtatggggtcacctaacttcaacttacttt

SEQ ID NO: 82011 - DNA, 190 bp, Zea mays
  Clone ID: LIB3114-024-P1-K1-E3
aaaaaataaaataattaataaaaaaataaaaatttatgtcagaacatttaaaaatacacaaggaaaatatcccttagcgtgcggggggctttcctttatcattgtgcctcctaatattcaatctccctggcctctctttttcatccttcttgtctggctctaccttgtctttaccctccttttatttttt

SEQ ID NO: 82012 - DNA, 54 bp, Zea mays
  Clone ID: LIB3114-024-P1-K1-E4
gctacgtacgcgtgatgcgacgtatagctctttatagagcacctaaactcaatt

SEQ ID NO: 82013 - DNA, 333 bp, Zea mays
  Clone ID: LIB3114-024-P1-K1-E5
gcctattggcctaaactgaataggtgtccgttgtttactgtttaaatgctgtttaggtgaacacttcttgtaggtagagggcgaggtgctggattgaatctgagcagcgagggtgccaagatgccgactggctgtgtgcgggttcactgtgtgtcatcagaagtatatgtttttttttgtgtcgggacggggctagatttgggggtttgacagctgtgtgagtgcagaagctgaaagggagtaggtgggtttcttaggattaacaaattacttggatttatgaatggagagtgttatatgatgaagtctcaactttggagattgctcacttgt

SEQ ID NO: 82014 - DNA, 53 bp, Zea mays
  Clone ID: LIB3114-024-P1-K1-E8
ataaaaaaaaatatattaaaaaaaaaaatttattaatataaaaaaatatataa

SEQ ID NO: 82015 - DNA, 307 bp, Zea mays
  Clone ID: LIB3114-024-P1-K1-F11
aaaaaaaaatagcacaaaaaatgataaaacactttaaaaaaaaaacagtacatacaagaagagccgagccgaagtgacagtggggtggtgtcctgcgcctacttgctctacattggcctccagtggacgccatctagcttgccggcggtgccttcgtacgctgtggagcttggtcagctgtaccgtctgtttttgacttccaacacctttatacggtaggctgtctttgcccttttttatacctgtgccatatgagccatatttttttcgtcaacgggctgtcttaggccgacatgatcgtcctttc

SEQ ID NO: 82016 - DNA, 56 bp, Zea mays
  Clone ID: LIB3114-024-P1-K1-G2
tacaggtggaccaatacctcgtattgcacatgatccacatctaacatgttaagctg

SEQ ID NO: 82017 - DNA, 226 bp, Zea mays
  Clone ID: LIB3114-024-P1-K1-G7
aaaaaaaaaaaaaaaaaaaaaaaaaaaaataaataaaaaaaaaaaaaacaaaaaaaagaaaggaaaactttaaatcggggggatgcataacttctaacttacttcttctttaaatcgtgtgttctctcccttttttcccccttttctccctttgcgcccctctcggttcatccctctttttttttcccattacacttcatttcccttcccgctcccttttccccca

SEQ ID NO: 82018 - DNA, 357 bp, Zea mays
  Clone ID: LIB3114-024-P1-K1-G8
aaaaaaaaaaaaaaaaaaaaaaaaaaaaaaaaattaaaaaaaaaaaaaaaaaaaaaagaaaagggaaaaaaaaaaaagggggttgcataattacatactaggggcggcctctttatagattctatgtttttcgtccccttgcttgaatcgtctatccttttttttagggcctcctaatttgatttaaccgtccggggttttacatcatttggattgttaaaacctcttctttcccctactttaattcttggaaaacatcccctttattcctctggcgtatattcaaataggcctaaactcttttgctttttccaacttttgcccacctttattggcgtttggggtggtccttttttc

SEQ ID NO: 82019 - DNA, 329 bp, Zea mays
  Clone ID: LIB3114-024-P1-K1-H10
aaataaaaaaaaaaaataaaaaaaaaataaattttattaattgaaaaaaaaaaaaagggatgggtaaattaaaaaagggggatgggaaaaaaataaaaacaaatattaaaaaaaattttcctatggggcggccgttttaaagtacccaagtttactcccccctgcatacaccctatttacctttttttttggccccctaatttctattccctggccgggattttaaaacccttgcaccggaaaaaccctggggttaccaaatttatttgctttgaaaaaaatccccttttctccaggtgggttttaaaccaaaaggccccccccctttc

SEQ ID NO: 82020 - DNA, 457 bp, Zea mays
  Clone ID: LIB3114-024-P1-K1-H11
tttttatatattatacaacacataattaaaaattcaaaaatacataacaaaaacatacgagggaataaaatattgtttggtgggggccctaatatatttaatttcaccggccgttctcatcctaggtacttgctttatccctgtccccccctaaactttattttcctcgcctggatattcacccctttttctgctggataaatttctgttttacccctttttttcgcctttccccacattttttcctcctcaatttgtctaataaaccaccccctttttgcgcacttttttctccacgtgttgttgtttcctcttaccatgttctctccccttttctagtgccttttttcccctctccttttgttttgtttccctcccctttttgccctcattcttttggctttccccttctaaccttttatttgtagttttcccttttttttttccataaattttt

SEQ ID NO: 82021 - DNA, 166 bp, Zea mays
  Clone ID: LIB3114-024-P1-K1-H5
ttgaagaacggccccccccctttatcgaatcatttacccccccggatttggttatttcccccaccttttctctttcctttacacgcgccctaagtcccggtcctttccattttttccctttctttttcgccccgttcttcaccttttcccctttaagttctaaatt

SEQ ID NO: 82022 - DNA, 390 bp, Zea mays
  Clone ID: LIB3114-024-P1-K1-H7
aaggaacagaaggagggcagtgaagctcggtttccttgattgctagcagtattatcttgtgtcatagtggacccgctttcgtccagcggtggtgccaatatttagaagcatcacctggcctgggcagatgtagtgtgcgtcttatagtctctgctttagatgtgcaatgtaacgaagctttagcacagtatgaactagaccgcataaaagaatccatgtccattccgccagtaatacgagcgggttggtatctgactccttagagtcaaaagtctgtacaattgtatcgtcgctccaaagcaaaaaaaaaacaataataatgtgctggagaagcggcgatgacttcacattgtacacctttaccagctggaatttgacagaagtttggaa

SEQ ID NO: 82023 - DNA, 474 bp, Zea mays
  Clone ID: LIB3114-024-P1-K1-H8
tccctggtcgacccactcgtccgaaaaaaaaaaaaaaaaaaaaaaaaaaaaataattaaaaaaaaaaaaaaaaaaaaaaaaaatgaaaattactaacattaaaaaaaggaacaaaacttacttccctatttttaaacctcttttcttttcttatatattctcccaattcccttttatttactcctccttaaactactttttcattccttatacttaatccattccccatttataattcccttctttatctccccctttctctctctatcttaatatataatttttcccatccattcttctttcataatctcttctctaccccattttccaatttctctccccctttttctattctttttcccccccctttattttactttccccccccctgttcccttttatttacccccccctatacccctatttttctcattttttttactttcctttcctctcatttttctctactttttt

SEQ ID NO: 82024 - DNA, 71 bp, Zea mays
  Clone ID: LIB3114-025-P1-K1-A11
taaaggaggcaagctttcttacgcgggcgtgcgacgtcttaacttttctataaagtcacctaaaaacaatt

SEQ ID NO: 82025 - DNA, 473 bp, Zea mays
  Clone ID: LIB3114-025-P1-K1-A12
acctgtccttaattccctggtcgacccactcgtcccgtattttctcatttcttaaaaataaaaatattaaattttaaaaaaaacaaaataaaaaaaaaaggggaaaatataaaaaaaagagagtgacaaaaaaaaaaaaatttttcccccctttctaaaatccctatttttcttttctctcccttccccttctttatccctatatatactttcctctccttccatttcatcttcctctttttttaccccccttcatcttttacaccctcctcttttccccccttttctccttttaaaacaccctccctttccccccttttttcttttttataaaaaccccccatcttaccactcttcccaacttttacccacccctaattttatttcctccccccccttttcccccccctttttcgcatttgtctcccctcttccccactcttttacccccccattttttatctccccccccc

SEQ ID NO: 82026 - DNA, 107 bp, Zea mays
  Clone ID: LIB3114-025-P1-K1-A3
aactaattatagatcaaaaagcaaacaatataaaaaatcacaaaaataacatacacatacatacaggggacagagctcttacgatgagagggacctaaattcaaatt

SEQ ID NO: 82027 - DNA, 430 bp, Zea mays
  Clone ID: LIB3114-025-P1-K1-A4
ggaaagtggaagacctattgatgcaattaatttggcttatgtgtttgagcttactgaacaatgtgaaccagtacaccttcttaaagcatatctaagggatgttaagaaaatgtcacacgccaggaatgtcaaaacttctcctggagcacagaatgagatgaatgaacgtgagttatctgcgctgaaatctgtcattaagtgcattgaagagcacaaacttgagcagcagtaccctgtggatccacttcagaaaagggtttttgcagctagagaaagcaaaggcagacaagaggatggctgttgaagcagcaaagccgcagtccaagaggcctcgtgccaatggatcggcctttgcaacccgtgctacaggctttgctgacaagagcttctactcagcaaccccagagaggcatccattcaatccttgcga

SEQ ID NO: 82028 - DNA, 315 bp, Zea mays
  Clone ID: LIB3114-025-P1-K1-A5
gcctgcagtaccggtccttaattcccggttcgacccacgcgtgcgaactagttttagatctatagctgactctataaaaaaatccaatcttacatacacataacatacaacgaaagagctcttctatagtggggcgtgggcccaattaactcttcaacttttatacaacagtcatgtcttataaaaccctgtcttcacccatcttaatctttttgcatcacataccccttttaccagctgtcgttatagcaaaaaggccttcaccgattgcccttcccatctaattgtcatccctaattttaaatattactcatc

SEQ ID NO: 82029 - DNA, 138 bp, Zea mays
  unsure at all n locations
  Clone ID: LIB3114-025-P1-K1-A6
acccgtcctaattccctgtcgacccccccttcggntttttttttncttcttctttcattaaaaaaaatatcaaaaaagccggcccctctaaaaaagaggaaaatttcatacgcgggcgtgtcggcgtctttttttttt

SEQ ID NO: 82030 - DNA, 145 bp, Zea mays
  Clone ID: LIB3114-025-P1-K1-A7
gcccgcaggtaccgatccgtaattcggggggcgcgtcccgccttcgttcttatcgcgagcggccgctctagatgatccaagctcacgctcacgtacacgcgggtgcgacgtcatagctttgctatagcggcacctaaattcaatt

SEQ ID NO: 82031 - DNA, 457 bp, Zea mays
  unsure at all n locations
  Clone ID: LIB3114-025-P1-K1-A8
gaaaataaatattnattaaaaataaataatttaaatattaaataaaatattaaaaaagggaatatgttttttttgtattgggtggntatttttatattttttttataattaattcaatttattttctaatttttactttatttctaacaatttttatattttataatattacattttttattggtcttgttttataatttattttttttatctttctttctattttaaatctttctttatatctaatataaattacatatttatctctgtatttatacttatttttatttttttttaactttctattttgacactttttactatttcttttccctattaacttttttttatcttatttttttttttttttaatgtttatctttttcaattttttttttcaaatttattttaaatatttttaaaatattttttattccttcccttttttgaattttta

SEQ ID NO: 82032 - DNA, 408 bp, Zea mays
  Clone ID: LIB3114-025-P1-K1-A9
aaaaataatcatttaataaacaaaaaaaccttaaaataaaaaaaaaataaaaaaaaacagataaggacctataataaaaaagaggatatcgaccactataatctttctcatatccatttattataatttaccccttctttcattttatttgcccatctttttcttataacctcaattctctatcctcttgtcgctcctcattataaatatatttaaatttctataacctcttttttccacctttttttaatattctcctattcccttttccttttttccttcccaccttttttcctcattcctaaaatttacaactttttcctcctccttttaactttttctttctttccctttttataattttatcctctacccttttactcttttcctcctttacacttatttcct

SEQ ID NO: 82033 - DNA, 456 bp, Zea mays
  Clone ID: LIB3114-025-P1-K1-B1
aactggaggaactgagcggtggggtccgctgaggcctagttatcttgttcgcttctgctaccgtgttcaccctagtctagagggggtttatcttcgtctgtggtcgtctcgtgtccgtatgtttcgtttcgtgttcgttgttgttgttgcccatctgtgtttttgaccgcaagctcgctcctctgatgttgttaaaaaaataatatataaaaaaaaaaaaaaaaaatatatataaaaaaaaaataataaaaacaaaaataaaacaaccaaactacacattactaactaattacacatataagccaaaaaaatacatatatacttaattgggggggccccttttaagggtccaacttttcttccccgggacatcgaaggttttattttttttttggggccccttaatttaatcgccgggcccgggttttacaaccgggggactgggaaaacccgggg

SEQ ID NO: 82034 - DNA, 422 bp, Zea mays
  Clone ID: LIB3114-025-P1-K1-B10
tacgcctgcagtaccgttccttaattcccgtgttcgaccgactcgtccgatataccaccattttaaaaacaaaaattaaaacaaattaaaaaccaaaacaatataaaaacaaaagaaacaccatactaacggtgcgaggcgcgcacaaattactaccacattttcttccaccttcattgtatccgtcttttcatgagctcctcttaattatggccatcttcttctacatcctttctctgatattccgctttttttttaacttcccctttttttatttatttttaacacatatataaccttctttacctattttacattaatttataccatctgcttttctttcttaaatttttcatatttacccaccctttatattccattttattttctttttttattatcaatcctcttttttttaattt

SEQ ID NO: 82035 - DNA, 102 bp, Zea mays
  Clone ID: LIB3114-025-P1-K1-B5
cccacgcgttcgatctaaaacaaccgctctagaagatccaaacttacatacacatacatacgaggtcgagagctcttctataatgtgaccggaaattcaact

SEQ ID NO: 82036 - DNA, 159 bp, Zea mays
  unsure at all n locations
  Clone ID: LIB3114-025-P1-K1-B6
ctttacgcctgcatgtaccgttccctaattcccttgtcgacccactcgtccgtaatatcttccgttntttataataaaaataaaaaaaataaaaattaaaaatttacatacaaaaaaaaaacagaataataaactaatatagagtgtggtccttttttc

SEQ ID NO: 82037 - DNA, 310 bp, Zea mays
  Clone ID: LIB3114-025-P1-K1-B7
actttatatattccaagcttccttacgtttccatacaaagtcatatttctccaattggcccacctaaattcatttcattgtcccccattttacaactccggtactggtaaacccctgccgttccccaactaaatcgctttggaccacatacctttttcgcatgttgcctttataccttataggccccgaccaatagcccttctaaacatttccgcaccctttttgcaaattgttaccccccctttatcggctctttaaacccgccgggtgtgttttttacgcccaggtggaccggttaatttgccaaggc

SEQ ID NO: 82038 - DNA, 194 bp, Zea mays
  Clone ID: LIB3114-025-P1-K1-B8
tctccccccccccttacttaattttttatattattttattttactttctcttacattatagttttttttttttatatgagatgatctacacttatcccactttcctcactaattacaacttatcaactgataaaaccctatctttacccatctttatctcctttctataaattttcaacttatcaaataaaata

SEQ ID NO: 82039 - DNA, 501 bp, Zea mays
  unsure at all n locations
  Clone ID: LIB3114-025-P1-K1-C10
ccttatatccctgttcgacccactcgtccgaaataaaattatttttaaaaaaaaaaaaaaaaaaaaataaaaaaaaaaaaaacaacaaaaaaaaagataaatacatatacattcgcttgggaccttcaccctttttttttggcctctcttttttttttttcatttccccacctttctacactctctccctttttttcttttttctattccttaacctatcttttttcccccttcttcccctttttcccttttccatccccctttttatttacattcctatccttccttcccaaccccacttttcctttttntaaatttttaacaataatatcccctccctcattctccttcaacattttttttccctttcccaccccccattnnnnatccccctttcaccctccctattccccccttgggccgtgcgtttcttcctctttcctttttttcccattttcctctttcccctccccttccccccctagaccctttatttttcct

SEQ ID NO: 82040 - DNA, 101 bp, Zea mays
  Clone ID: LIB3114-025-P1-K1-C12
atcgatggatgaacatgaatgaatgaaccgaactgcacagctccgttgtgagctgatgcatgcatgcactaaaaaaaaaaaaagagaactaaattcaattt

SEQ ID NO: 82041 - DNA, 74 bp, Zea mays
  Clone ID: LIB3114-025-P1-K1-C2
tctagaaaatccaaaattacgtaccctcgcatacggagaaatttctgttgggtggcgtgccctatatccaattt

SEQ ID NO: 82042 - DNA, 266 bp, Zea mays
  Clone ID: LIB3114-025-P1-K1-C6
cgaaataccgtgggagagggggtgataaggacggtggggtttctatgttgaagtcgtggtcatggacaatttgtgattttttctcctttatgccatgttttggaatttttgtagctgcctaggccttgtggtaatgtgctgctgtgggggttcattagtatgaagaggaagacgctgctggcgctgagtctttctctttattagtattttgtttaaaactatgtatgaccgaatggtggtatttatttgtgtcatccttgactctt

SEQ ID NO: 82043 - DNA, 249 bp, Zea mays
  Clone ID: LIB3114-025-P1-K1-C7
cccacgcgtccggatgagtataaagaaagctatttatcttttgatttagttttgttttttttgtgggctgtacaaaggtcaacgggtgaagagagctttgtgttctaacagagtcgaagggttattaccatctgatcttgggtaacttaattatttgggtgtaggtcgattccatctgtaaatgtatatttatgagggagtacgtgctcgcgggcctcttatattataaacaaaaggaggaatttattt

SEQ ID NO: 82044 - DNA, 372 bp, Zea mays
  unsure at all n locations
  Clone ID: LIB3114-025-P1-K1-D1
aaatantntnntntnntttataaaaaaaaaaaaaaaataaaaaaaaaaaaaaaaaaaaaaaaaagggaaatttattaaaataaaaaagggcgggccctttaaaaatatccaaaattataatacccatacatacaaaataaataaattgggcccccctttttaataatccaaattttcttcccccttttttccaactttttacctttttttttccctcccctaacccaatttattcgccctgcttttcaccccccttttcccggaaaaccctttggcttcccaactttttcccttttgcaatttccccctttttccccctttgtttttatattaaaaggccccctccctttcccctttcccaacattttcccc

SEQ ID NO: 82045 - DNA, 275 bp, Zea mays
  Clone ID: LIB3114-025-P1-K1-D11
tccaattcttccttcccctttcttccaacattttaccttttttttattttcccctcattttttttccctgcccttccttttacaacccttttacttccaaacccattccgtttcccaactttaccccctttcccaacttcccctttttcccatttgcctacatcccttacacccccccaccattctcctttcccaactttttcccctccttatttctctaatttccccctccctttctcgtcctttttacctccccttttatttttttttctccc

SEQ ID NO: 82046 - DNA, 353 bp, Zea mays
  Clone ID: LIB3114-025-P1-K1-D7
aaatatatttcttctttaacaaaaaacaaataaaatataaaaaaaaaaactaaaacaaaaaagagggggaaataactaaaaaaggggggggaaaataatatttatctcctactatactaatcacttatatgctttcttcatcatcacttctgtataccatcaagatcctgaacttcatcaactttcacctcatcaacccttttcattgtcactgtcattaaggaacacctcctcgtttctatattcatacccaacatttatatccacattgtcagtcttttacacccttcactttctttttgcagctttttgctatgtctagttttctcccatttgctttacctttaaacata

SEQ ID NO: 82047 - DNA, 448 bp, Zea mays
  unsure at all n locations
  Clone ID: LIB3114-025-P1-K1-E2
nattantattnntcgttaacaatacaaactaaaaaattaaaaaaaaaaaaaaaaaaaaataaaaggggaaaggtacatatataagaatggggctgggcccctcttttaaataccccatttttctaacccttttttccataataaaacctttttttttatattaatggggccccccttttattggcccccttttttccccccccctttttcgtaaaaccctcctttttttttggccccttctacttaattcccctccccctttttcccccccccctacttttaaaaccccccttccccccccccttttcctccctttcccccccccctttttttaatgtttcccaccttttaagtgggccttaacctttccccttttcctactttttcccccccttttccttttttttcgcccccccctttccccccctttttccgcggttgttttttt

SEQ ID NO: 82048 - DNA, 307 bp, Zea mays
  unsure at all n locations
  Clone ID: LIB3114-025-P1-K1-E7
ggcgcgcgcgtgagcgtcaactgcttctgccccgggttcacccccacnttcatggccgagggcttggggaagcgcaccggctatcattcctccctcntcgccgcgcggctcgcgctgctggcgcccgccgagctccccacggggaccttcttcaagtggtgcacgccgcagctctactccaagctgtgactgtgactggatagctacgcctaccgtcgtcggcagtgtgtgcgtgcgctccgtgaacgctggagtatatatattttagttcgggtcctttagctactctgctcagaagtcagaaacg

SEQ ID NO: 82049 - DNA, 68 bp, Zea mays
  Clone ID: LIB3114-025-P1-K1-E8
aaataaaatctatcataaaaaaaaaaaaaaaaaaaaaaaaaaaaagaaaaaaaaaaaagagaaaaggg

SEQ ID NO: 82050 - DNA, 164 bp, Zea mays
  Clone ID: LIB3114-025-P1-K1-F10
aataaatccattttttctaaacaaaaacaataatatataaaaaacaaaacaaaacacacggaaagagctaaaaaaaagataggtacaggtacatacacattcccatcttctttatcacctcccatcacataaacccccagcacctctttctccacccgtttgac

SEQ ID NO: 82051 - DNA, 411 bp, Zea mays
  Clone ID: LIB3114-025-P1-K1-F2
tacctgtccagaatctccagacgtggatctaaattatacgagccatccaaaggggatggctcactcatcagtgaagagagctcagggggtgagaataagagggggataggcgctagaaccgaaagggtacagtttcctgagttgcctttttttatttttcccgcgtctcctcgagcagcagtgcgtgggaggagacgcagtcgactttgcagggagttggttaatcggtagactgatgggtgcgaagaaggtcaagtcaaacggctcaaccagaggattaacacctttgcttttctctttctgcatctgagatgattgcaaacagttttggtttaaaaattaagaatcttgaatcgtattcggtgctgtgtgcttgtcggctaaatgtatctgttgcgttgatatccgatt

SEQ ID NO: 82052 - DNA, 241 bp, Zea mays
  Clone ID: LIB3114-025-P1-K1-F4
aaaaaatttttttcttttttatataataatataaatataaaaaaattaaaaaaaaaaaaattagggttagatgtttacttgataaagggttggggttctaaaattaaaatacaaaaataaaacacttggcggcccctttaaagagactaactttatgtacctgttgatcacaactattaactttttttttgggggtacaaaatataattctctggcccggttttttacacggtgtacatgt

SEQ ID NO: 82053 - DNA, 462 bp, Zea mays
  unsure at all n locations
  Clone ID: LIB3114-025-P1-K1-F5
gacagggttgagtcagtaccacctgtctcactggcctagaatgtttgaggtgatcaggatgctggaaggagacatgctcacagagagatgggaggtgtcgcanaacgtggacatgccagagttcgtctcatcggagctcctacttcaaaagtacatggattttgcagcggacgaatgctcgcttggtgtagaagccatggagctctctggactaaggtgaccatctgatcgatcgaatcggccatcacacaggtcgcataggtgtcttgccatatcaagcctatattattgttgtattacattggacacatagggaagggaaaaaatccggtgaattatagggtgtgatctgtctgcctatacttgtggtggcattcatttgtgcaaatgattttgatatattgatgtagagaatatatatgttggttatttctatgtaatcgttgcacactataatttatc

SEQ ID NO: 82054 - DNA, 342 bp, Zea mays
  Clone ID: LIB3114-025-P1-K1-F6
ggcggcaagaagaaggcccccaaggcgaagacgaactagggctggttagatagctgcacgcctcaggcggggtgtatcatgccacaggtctatttcgaagcaggcccagcgcgatgcagcgaatgccatcgagctgcgcttttacatgtttatcatcagattccattttgcggggcacggcccggacaaaggtgtgaccggggtgggttaggcgactagattgcacgattatgtacttgcgatttgtttgttgaactgggttgccgacagttaatcttcatttgattttaaaaaaaaaaaaaaacagggaaataatagggagagaaatgtatgaatatactt

SEQ ID NO: 82055 - DNA, 388 bp, Zea mays
  Clone ID: LIB3114-025-P1-K1-G1
gcctcggggtggagtgctaccggcggtcgttcctgatcgtcacggcggccacggtggtcggcgcgctggtgtcgctggtgctggtgtggcggacgtggacgttctacaggggcgacatatacgcgaggttccgggacggagacgagggcccggggcgggacgggcgcctgccggtcgaccagaaacgggaggaggaggagagggagaaggcggcggccaacggcaggaaggcgtgaggtggtcagcgtgagcggtaaggcatggtcatggaccgacgactggtggggtgtacatgtacatgtgaatatagtactttctcgttgcattcacccgtgatgaccgacccttgctacctttcaaatttaaatagcctaaaaaaagccttctt

SEQ ID NO: 82056 - DNA, 76 bp, Zea mays
  Clone ID: LIB3114-025-P1-K1-G10
actctataagatcacaagcttacatacacatgcgtgcggggtcataggtgtgctggagtggcacctaaattcattt

SEQ ID NO: 82057 - DNA, 141 bp, Zea mays
  Clone ID: LIB3114-025-P1-K1-G12
gtaccggtcctgaattcgcgggtcgacccacgcctccgtactatttctttttcgccagctgtcgatctatcaatttcccagcctacgtacatccggaggcggcgttattgctttgatagagcgacacctaattccatttcc

SEQ ID NO: 82058 - DNA, 503 bp, Zea mays
  Clone ID: LIB3114-025-P1-K1-G2
ctttccgcctgcatgtaccgttccttaattcccttttcgacccactcgtccgaactagttatggattttctatcttccactattaatatttcacattcttacatactcataacatactacttcgttggtcttgtttagtggggcctggcgtttttttcactttccgtttcttttcttcttcttcccttcttattccctttcttttcccaactttatgttttttctcttcatcccattttcctcttctcttcttgcatcttccatggccttaccctttttacttcccttcttttcccccctctttttcttcattggtcttccccttttccctcccctttttatcccccttccctcctgtttactcttcccttttccctattctcttctccctttttatccccccttttccccccctttctttcctttctttctcctcagtttccttttcttttccccttcccctcttaaccctttccttcctttttttcttcctttttttcctt

SEQ ID NO: 82059 - DNA, 408 bp, Zea mays
  unsure at all n locations
  Clone ID: LIB3114-025-P1-K1-G3
tcccgggtcgaccgacgcgtccgaaatnttnnncggnnnnggttgcttaacaaaaaaaaaataaaaaaactcctacaaatacaaaaacggggagaaacacctgaatcgccaagggagcacgaacatatcttaggggggggcccgttttaaagaaccaaacttatccaccccgtccatgaaacgtaataaccttcttttggggcaccctaattcaaatcaatggcccgcggttttacaccgtgggacctggaaaaaccctgggtttcccaaaattaaatgcctttaaaaaaaacccccttttccccagttgtgttatttccaaaaagcccccacccattcccctttccaaacatttgcccatcttaattgcaaaatggacccccccctttaccgccccttaaaccccgg

SEQ ID NO: 82060 - DNA, 465 bp, Zea mays
  unsure at all n locations
  Clone ID: LIB3114-025-P1-K1-G5
catacaancnnnnntagttctaaaacaaacaatattaaaaaataccaaacttacatacacatagggaaagagatcataaataataaggtggtgggacctaatttaaaattcgctgcccatttttttatctccttccttttctttacaattccttgactttactcatactttatttgggggcccccttttcttttcccttcttctctccttttacctttacaggccttcacctttcttcgttgcccccaatttcttttcctgggttgcattttcaactcgccctgttgtgtatctttcagccctcccccttttttattccctttcaaaaattccccttcacttactgtgggatttatataacacatcctttcccctctctttccttccttaattttcgccctttcccttcttttttttcccccccccttttttttgggccttttttctccgtttttttgttttttt

SEQ ID NO: 82061 - DNA, 202 bp, Zea mays
  Clone ID: LIB3114-025-P1-K1-H11
aagcagttgtacttgggttgctagagctatcgacaacccaagaacactttctcttagggggggcgattcagggggtgggttgtgtctccatttctcaatgcacaccccctaatcattcaccgacgggggggaatacaatgtcacaaaaatcctcctggtgcgcttctcggacaactacttttttcttactccgcgggagaac

SEQ ID NO: 82062 - DNA, 77 bp, Zea mays
  Clone ID: LIB3114-025-P1-K1-H2
aaataaaaatataaaaaaaaaaaaaaaaaaaaaaaaaaaaaaaaaaaaaaaaaaaaaaaaaaaaagggaaaaaaaaa

SEQ ID NO: 82063 - DNA, 77 bp, Zea mays
  unsure at all n locations
  Clone ID: LIB3114-025-P1-K1-H5
nggacgcgtggggttaaaatactaccatagaaacaatgaactctctcctacaaatacaaataagtggatggacacct

SEQ ID NO: 82064 - DNA, 464 bp, Zea mays
  Clone ID: LIB3114-025-P1-K1-H8
gactagttctagatgtgcttgcttcctaaaaaaatttttacatctaaaaaaaaaaacaaaaaagggaaatataaaaaaaaaaaaaaggaatcatcaaataataataaaaacactaaaaacaaaaaaaaaaaaaataaaaaaatatggggcgccctctttaaaaatcccaagctatcctccccctccttccaaccctatacctcttttaaaggggcccctaattttaatcaattgccctgctttttacaacttttctactgtaaaacccctgtctttcccaaactaaatccccttacaaaaaatccccttttccccacttttcttaatacctaaaaggccccaaccaatcccccttccaaacaatttcccaaccttaattgcaattggtcccccccctttttctccccttttaacgcaccggtttttttttttactcccatttttacccattcaatttccaaccc

SEQ ID NO: 82065 - DNA, 427 bp, Zea mays
  Clone ID: LIB3114-027-P1-K1-A12
cgtgatggcaatggagaagaagaacgagaggaccctgaacctgctgcaggagtgctttggtgaagggatcataaccatcaaccagatgaccaaggggttctcaagggtcagggatgggctcgacgatctggctctcgacattcctgatgccagggagaagttcctttcctatgtgcagcgcgcgaagaagagtggatggctcctgcctgggttcggtgtggcatcttcggcttgaacagctgggcagaagagaagtacgaagctgaagcggctcagcaaacccagtttggatgtgtgttttcgtcgttcgtggttgcccttgcgcctaggttagcggagcgagcccttcctggttgcggtggtggtggcttgtgtaggtctcgcatctgacatgttcatgctgttcttgtttcatttcatttaactc

SEQ ID NO: 82066 - DNA, 386 bp, Zea mays
  unsure at all n locations
  Clone ID: LIB3114-027-P1-K1-A2
cgctggtactcctgcacgctccggcccgtgcttgccgggtcgacccattcgtccgcgcacgcgtccgcatgggcgcaatatatccatgacaagttagttattaagagatgttcagtggggaacttgtttgtgtagttactacaatacgacactcaccagagattcagtacagcgaaatggggctcttgagaatttgtaacaggaagttctgtatatccttaggttttaaggtttgttgtcgcccttgctatatgtagttatacgtgtacacgtcctgatgtaaaggttcacaaaaaatcttacagatgaccacgggatgtaaattcgaaagtttgtgcgnnaaaaataaaaaataataaaaataaaaaaaaaaaaattaaaataat

SEQ ID NO: 82067 - DNA, 208 bp, Zea mays
  Clone ID: LIB3114-027-P1-K1-A8
ctcctgcacgttcctgcccctacatttcccggtccacccttcccttctcgacccactcttcctaacgagcagccgctctagaagatccaaacttacatacacaatacataaagggaaaataaaataaggtattgtgtgctataaatcacaaaacaataaaaaacaattcatactaaataaatctttctttaattccttttacattact

SEQ ID NO: 82068 - DNA, 413 bp, Zea mays
  Clone ID: LIB3114-027-P1-K1-B12
aaaaataataaaacaaaaaaattttaatctaaaaaataaaaaaataacatacgctataaataagagaaaattactatacatataaagtcccctataatatatttcactttctcgtcactttacatcttttttacttccaaatcctttccttttccttacttcttttttctttcacttcacccttctttttccccctggcgttctttcctattttcccctgtctctatctctctttctttcagcctactctttctttcttcttctatccgttcccctctctcctattttctccatttcttcccgcccctcttttttcttttctctttctctcccttctctttttcccttttttcccccctccctttttccctctttccttttctcctttggtttccactttcctacctcccctt

SEQ ID NO: 82069 - DNA, 469 bp, Zea mays
  Clone ID: LIB3114-027-P1-K1-B2
tactcctgcagcgtaccgtgtccgtaattcccgtgtcgacccactcgtccgtaataaaaatatataaaaaaacaaacaatataaaaaataaaaaaaaaaaatacacaaaaaatagggaataataaataggagatataatgggacactaaatgcaatatactagcttttcctttttcaacttccctactttccaacccttatcttctcccttcttaatccctttgcaatacattccccttttttcatctagcataatctcttttactccctcacctttccccctttccttccctttcgcaaccctccttttcaaattttcccctcctttttacttttcattcatctcgaaatctcttttcccttctctcctttacttcttttcacattcttactccctatattgccctcttttatcctccttgcttccccttttttacccttacgtcttcttccccctttctacctcttt

SEQ ID NO: 82070 - DNA, 486 bp, Zea mays
  unsure at all n locations
  Clone ID: LIB3114-027-P1-K1-B3
ctcctgcacgtacctctcctaattcccttttcgacccactcgtccgaaaaaaatttatatataaaaaaaaaaaatataaaaaatttaaaaaaaaattataaaataaaaaacggaaaaattaatagtaaaataataaaataataatttaaatttaatatanntaaaattttaatattattattttgtggcccccccctttttaaattcccatttttccttcccctttttttccaatttttattttttttttttggccccctaattttttttccctgcccccttttttcccctttttctttgaaaaccccttgtttcccccattttttccctttaaaaaaattcccctttttcccctttttttttatataaaaaaaaccccccccccattttccccttttcccacaatttttcccacccctttttttcctttttttccccccccccttttttccccccttttttaccccccccctttttttttttttt

SEQ ID NO: 82071 - DNA, 373 bp, Zea mays
  unsure at all n locations
  Clone ID: LIB3114-027-P1-K1-B7
agagaatcatcagactctgctgctgttgtcgtgatcacacaagaggcccatctaagttcgtatatgtacggatggaatatttatgcatgtatgtatttatgtttatctccctgcatttacccttagtgcaacagggtggtaggggacggttgtagtattccaaatttatgtatcaaataaatgaggacactgtccttggggtgcaattgtgtatataatataataatagggagctactcgccatgatttaggatattttatttaactgttgtaataatatgcagtgttttgtatgatgaccccatttttttatatataactgttcattttaaaaaaaaaaaaanaaaaaccatattaaaaaaaaaaaaaataa

SEQ ID NO: 82072 - DNA, 430 bp, Zea mays
  Clone ID: LIB3114-027-P1-K1-B8
aaaaaataataaaactaatgaataataatataaagatcacacaaaaaagcggatataaattaaaagtatgtacggatgagaatatttatgcatgtatatatttatgtttatctccctgcatttacccttagtgcaacagggtggtaggggacggttgtagtattccaaatttatgtgtcacataaatgaggacactgtccttggggtgcaattgtgtatataatataataatagggagctactcaccatgatttacgatattttatttaactgatgtaataatatgcaaaactttgtatgatcaccttatttttttatatataactgctcattttaacaattttggatataataatacaagggcctcaaccaaccgtctttcaaaaaatttgcctcccctttttgtgatttttttccccccttttttttt

SEQ ID NO: 82073 - DNA, 250 bp, Zea mays
  Clone ID: LIB3114-027-P1-K1-B9
atcatgattggacaggtgagcgagtggaatcctttacttctctgtcaaatcagaaagtgagggtgagcaaagtagaactagatatatatggttcattctgaaagtgagtgtacatagcagagtgagtagggttgggctatggctaacaaatcgtacatatgatcatgtaaaacactgttttgcattgcgaattacactgtttacattgtgtagtttgaaataagagatagagatgaataagctgccgcca

SEQ ID NO: 82074 - DNA, 389 bp, Zea mays
  Clone ID: LIB3114-027-P1-K1-C2
gaagggggtcgaagatggcagtgcgacttggtctgaacaacaagctgagcgggcagatcacggtcaggacaagcacctcggagcaggtccagatcgcacttctgggtctcgtaccggttgcagcctccatctacaggagcttccggcccagtgaaccgtccttcgcttattagcctgtcaggagtctcagtccaattacttcataaccatgtggtttctcttggcaattttcttcttcacatgaaccatgtttcttgctgtttcagtttactcccttgtaattggcagatcgtttcctaccataattttggctgaagagggttgtgcgatttatctggaactgtagctgaataaataatgtcgagaaatgtaccatccttgtgtttatc

SEQ ID NO: 82075 - DNA, 295 bp, Zea mays
  Clone ID: LIB3114-027-P1-K1-C3
cggacgcgtgggttttttttttttttttttttttttttttttttttttttttttttcatgcggtttttttttgggtttttggggcatttatttttttttttttttttttttttttctttttttttttgggcaaaacccaacctctacaatttttttccccaaaaaaaacgtgccccttttttccccaaaaaaaaaaccaaactttggttgcctccctcccaaaaaaagggtttaacaccctctttcccccccgttagtccccctttatctttttttaaatcgcggccgccctttt

SEQ ID NO: 82076 - DNA, 542 bp, Zea mays
  Clone ID: LIB3114-027-P1-K1-C4
tcctccaggtaccggtcctgaattcccttgtcgacccactcgtccgaaataaaattaattaaaaaaaaaaaaaaaaaaaaaaatttataaaaaaataaattataaaaataaaaaagagagaaaaataaataatgagaaagatataaagtaataacaatattgtttattactaaattttataaatttttctttctcttttatttaaattcttattataaccattactaatattaatcctaatctaatttacccttaaatatttgttgggcttcccttttttatttatattactctttttcttcctcctttcctttccttatcttttaatttcctttttttttcccccattttttcattttttcccccttttcttataattctgtttttgttttaactttcttatccccccctttttttttttttttaatcatttcccttttttttattgtctttttaaaaccaatatccccccccccttttccctttcccactatttttcctccctcatttttaaatttcctccccctttattattttttttt

SEQ ID NO: 82077 - DNA, 163 bp, Zea mays
  unsure at all n locations
  Clone ID: LIB3114-027-P1-K1-C5
cccgctccccttttannanattttttttttttttttttttttttttttttttttttttttggttttttttttgggtttttttgttttttttttggtttttaaaaggggaccttcttttactaaaacccctgaaacaatggggggctaaacataattttttttt

SEQ ID NO: 82078 - DNA, 166 bp, Zea mays
  Clone ID: LIB3114-027-P1-K1-C6
ctggttcgcctgcggttccggtccggtttcccggtcgtccgccgcgtccgggggggatactttatttttattattaatataatggggtttggtaacctggttttttaattttcggggggtctttagggtcgttgggggcccggttgggcttccctcctcctttccc

SEQ ID NO: 82079 - DNA, 427 bp, Zea mays
  Clone ID: LIB3114-027-P1-K1-C8
ggcttcgaacacgctctccatcatcgacagcggcatcggcatgaccaagtccgaccttgtcaacaacctcggtaccatcgccaggtccgggaccaaggagttcatggaagcccttgctgctggcgctgatgtgtctatgattgggcagttcggtgtcggtttctactctgcctacctcgtcgccgagagggtcgtcgtgaccaccaagcataacgatgacgagcagtacgtgtgggaatcccaggcgggcgggtcgttcactgttactcgtgacacgtctggggagcagcttggcaggggtactaagattacacttttcctcaaggaagatcagttagaataccttgaggagcgtcgcctcaaggatttggtcaagaagcactctgagttcatcagctaccccatctccctgtggaccgaaaagaca

SEQ ID NO: 82080 - DNA, 139 bp, Zea mays
  Clone ID: LIB3114-027-P1-K1-C9
tggtgcctatggatgctacaacaagaaagatcaaaagttcttggggatggatgcagctagatattttgttttgtattttctccaaaagagaaatttgcaacgttgtgagtgatattataattgtgatgcttttgtgaat

SEQ ID NO: 82081 - DNA, 364 bp, Zea mays
  unsure at all n locations
  Clone ID: LIB3114-027-P1-K1-D12
aaataaaaataaaaaaaaaaacaaacaatataaaaaataacaaaattacgggcacaaaacaaaaggacataatagggttatctataaagtcacctaaaattcaaatcactaacacaacaatttacaacatctatgactgaaaaaacacctgtctttacccatcttaatcaccttgcaacacatcccccttttgccagctggctttatagctaataggcccacacccatcgcccttccnaacttttgctctttctgaatgtcccattgaactctccctgcatcggttcattaaacactgctactgtaatgactactctcatcgcaaccttatcactttcaactacctatctcccgttccttttgc

SEQ ID NO: 82082 - DNA, 352 bp, Zea mays
  Clone ID: LIB3114-027-P1-K1-D2
cacaccgacagccacggtcgcatgctctgcaagctctcaggagaaactcctgaggccaagcatggagtcgacacgggatgttgctgcggctgcaaagattgggaagttgcttggagagcgcttgctgttcaagggtatccctgcagtatctgtctccatgtcaagagaccagaagtaccatggcaaggtcaaggccgtgatagattctctaagaggtgttggtgtgaaattgctgtagggaaaactgactgttttatgagaggttatgttggggcctcatgtttacctccgaagctgcttggcggccattagtttcgtgactgaattttcttatgggtgctggtgaacaata

SEQ ID NO: 82083 - DNA, 143 bp, Zea mays
  Clone ID: LIB3114-027-P1-K1-D3
cacaccgacagccacggccgcatgctctgcaagctctcaggagaaactcctgaggccaagcggggagtcaacacgggatgttggtgcagctgcaaagattccaaattttcatttagagcgctttgctgtcaagggtatccctc

SEQ ID NO: 82084 - DNA, 266 bp, Zea mays
  Clone ID: LIB3114-027-P1-K1-D5
accggtccgtaattcccgtttcgacccactcgtccgaaaaaaaaaaaaacttaatataaaaaaaaaaaaaaaaaaaaaaaaaaaaataaaaaatataaaaggaaaactttatagcaacttttacctcctaagctaatctcctcttttcttcccacctcctttcttcttttttctcttcctcttcttttccacccagtcctccttataacttaccctctttctccacctattttaactctttaaatatctctacctttttcccctct

SEQ ID NO: 82085 - DNA, 407 bp, Zea mays
  unsure at all n locations
  Clone ID: LIB3114-027-P1-K1-D6
gagtgagtcgatatcgatcagtagtagatttgtcgagtcaaggaaggggcctgctgctgctgctacgcgacagcgagcggccagatgtactgcctgcatgcatgcagtccctcccgttgactcgacccgtagagaagggatgggatggaagtagccgggtccttgggcgagtagcggcgccttggcacccacgggccagccgtactggcctgtgtgatgaaccggcgagagagatgagataatgtgcgagcgagagagggttggttgggttgtggtagttgaagaagacggntagctagctgctgctgctgggctctctatctggctctagatctgtgtatgtctgggtaatcgaggattccctcaccttgcatgccggctcccttttgtgtcaaattaaaaataat

SEQ ID NO: 82086 - DNA, 342 bp, Zea mays
  Clone ID: LIB3114-027-P1-K1-D7
acgcctgcagtaccggtcctgaattcccgtgtcgacccactcgtccgaaaaaataaataaaaactacaaaaaatataaaaaaaaaaaaaaaaaaaataacagaataaataaagaaaaaataaaaaaaaaaaaaactaaaaacatcctaacaataaacacactatatgtttcctccctttttccaatacccaccttttcctcttcttcatttatttccctttcaactacatttactaatctcctttttttttattgcccctttcacccatccctcctcttcttcaatccctttactttcccaagcttttccccttccctaccattccctctttcacacccttc

SEQ ID NO: 82087 - DNA, 228 bp, Zea mays
  Clone ID: LIB3114-027-P1-K1-E10
ggcggctacggcggcggtggcggcggcggctggagggactgatgtgtgggcccatcctgggttcggccgagttatcttatctatctatagtatcgtgttaccgttcgcttctgtcaccgtgttagtgtccgttctacctttggattaggtgttggtaccctgttgttcgctttggttgctcccgctatgaaacgagacgagagaagaatgagcaaggtttttgttcgc

SEQ ID NO: 82088 - DNA, 104 bp, Zea mays
  unsure at all n locations
  Clone ID: LIB3114-027-P1-K1-E11
naaaaataaaaaaaaaaaaaaaaaaaaaaaataaaaaaaaataatcttagggccaaaaattgagaaaaaaacaaacacctgctttctcctttactatcttcttt

SEQ ID NO: 82089 - DNA, 366 bp, Zea mays
  Clone ID: LIB3114-027-P1-K1-E12
gacgaaataggccgtgttttcttggacaatgatgttaagttcggcaagggtttcctttctgtttttttattctactgcgtggtctatgtgtatattgccaaaggcatgcgtgagccatgcgcccggtgctggggcgcagagaccatctgatggtggaaacaccggaaataagagcgtgccgctgtgtgtttcctttgaaggaataaaaatggtgttcgtgttgtgcccaaaaaaaaaaaaaaaaaaaaaaaaaaaaaaaaaaaaaaaaaaaaaaaaataaaaaaaaaaaaataataaaaaaaaaaaaaaaaaaataaaaaaaaaaaaaaaaaaaaaaaataaaaaaattggggggggcccctttaa

SEQ ID NO: 82090 - DNA, 188 bp, Zea mays
  Clone ID: LIB3114-027-P1-K1-E5
acttcatcctatcttggttgttgcctgatactgcattttcttaccataagttgtaacctcgtgttcttgcgggtgggtgtaggacacgacttttctgttaataatgttgtggcttgaactttccaggctgtggagattggggaaaactcacaaaaaaaaaaagttaaaaaacaaaaaaaaaataaaaa

SEQ ID NO: 82091 - DNA, 299 bp, Zea mays
  unsure at all n locations
  Clone ID: LIB3114-027-P1-K1-E7
cagaaacaggtagcttgtgatttgtgtagttaatttagcattgtatatgccattttattcgggtgcactgatgactaaaaatatcatgattgatatactgggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaanggggggggccgttttaaaggatcaaagtttacgtacgcgggcttgcaaggttataatttttttataggggaaccaaaattaaa

SEQ ID NO: 82092 - DNA, 404 bp, Zea mays
  Clone ID: LIB3114-027-P1-K1-F4
ggaatccgatccatccaagccaagccaaggcagagaagaagaagaggaggaagaagaagcatcggcagcatgtcggaggggactgccaactgcgtggacatcctgatcgccatcatcctgcctccgctgggggtgttcctcaagtacgggtgcggccacgagttctggatctgcctcctcctcaccttcctcggctacatccccggcatcatctacgccatctacgccatcaccaagaacacctagctagtcatccttgccgacgacgatccatgtctctgtatctgtgtctgttcatatgcctgatgccgacttgtgctgtatgtagttgcttgaattcagtcgggttcctgttttgctaaaaaaaaaaaaaaagggcgggcggtctaaaggatccaagctta

SEQ ID NO: 82093 - DNA, 82 bp, Zea mays
  unsure at all n locations
  Clone ID: LIB3114-027-P1-K1-F5
gaaaggaaaataatnaaaaaaaaaaaaaaaaaaaaaaaaaaaaaaaaaaaaaaaaaaaaaaaaggggaaaaaaaagaggaag

SEQ ID NO: 82094 - DNA, 409 bp, Zea mays
  Clone ID: LIB3114-027-P1-K1-F7
aaataaaaaaaaaaaaaaaaaaaaaaaaaaaaaaaaaaaaaaaaaaaaaaaggagaaaaaaaaggggaaaaaaaaatattggggccgccgttctaataaataccaactctcgtcctcgtgcacgccaaagttatatctcttctttagggtaacacaaattcatttctctggccgcccttttatcaacccattttcttggaaaaccccggcgttccccaatttaatgcccttggagaacataccccttttccccggtggccctttatcaaaaaggcccctcccctttgtcctatccaacatttccccaatctgtttatttaatgggaccccccccttttcttccctttaacccccccggttgtgtttttttcaccacatttccccccttttttttccctttccccccctc

SEQ ID NO: 82095 - DNA, 89 bp, Zea mays
  Clone ID: LIB3114-027-P1-K1-G10
aaaaaaaaaaaaaaaaaaaaaaaaaaaaaaaaaaaaaaaaaaaaaaaaaggggaaaaaaaaaggggaaaaaaaaaaaaaaaagaaagag

SEQ ID NO: 82096 - DNA, 339 bp, Zea mays
  Clone ID: LIB3114-027-P1-K1-G12
aaaaaaaaaaataaaaaaaaaaaaaaaaaaaaaaaaaaaaaaaaatatacggagaaaatttatggggcaaaaatgaatcataataaggcatcaacaaacaaaacccaacaaaaatcttgcttcctaacatcccatcaagagatcagtgcaggttattcgcatttggacatggatgcttacaaggatcatccatggttacacttttatccatagcttagagggagccttccttggccgatagccttttcaagaacttttaaactgtaaccatggtggccgaaaacaacgacatggacgcccacccctgtccctgccccgttttacaagcagaccaacctt

SEQ ID NO: 82097 - DNA, 97 bp, Zea mays
  Clone ID: LIB3114-027-P1-K1-G2
accggtccttaattcccgtgtcgacccactcgtccgcaaaaaaaaaaaaataaaaaataaaaaaaaaaaaaaaaaaaaaaaaaaaactttataaaaa

SEQ ID NO: 82098 - DNA, 366 bp, Zea mays
  Clone ID: LIB3114-027-P1-K1-G3
ccactcgtccgaaaaaaaaaaaaaataaataaaaaaaaaaaaaaaaaaaaaaaaaaaaaatataataaataaaaagagttaattacagagaaattaaagggaatatatatggccccttaaaatccttaaattttccactcttttacaacttttttactttttaaccctggtataccccaactaatttttttgggccccttctttatttcccccctttcctaccccccttttatcccctttcaattctcctttttcaacctctccctttcttttattggccaattttttccacccctttttcccccactaataccccccctctccccccctccttttctcttgttaaaaaaacaccccctttttcta

SEQ ID NO: 82099 - DNA, 352 bp, Zea mays
  unsure at all n locations
  Clone ID: LIB3114-027-P1-K1-G4
cccttgtcgacccactcgtccgaaaaaaaaaaaataaaaaaaaaaaaaaaaaaaaaaaataaaaaaaaaaaacaaacaatataaaagaatccaatataaggatcactaggcgttcaaaatcatatctcttctttccccctctacctaaatttactttcctccccctttttttccaccccctttttattattaatacccttttccttacccaactttttctcctttcaccaccttcccctttccccagcttancctattttaacccacttttctttccatcccccccttcccacccctttttctctatccccgaatattatatttactacctcctcccttttttcctttttct

SEQ ID NO: 82100 - DNA, 245 bp, Zea mays
  unsure at all n locations
  Clone ID: LIB3114-027-P1-K1-G5
ctggtactcctgcacgtacgcgacgcctgaatttcccggtcgacccactcgntccggaggaaaaaaaannnntaataaaaaaaatattatttttttaaaattcaaaaaaaataaaaagggaaaattatagaggaaaaaaaaggaaaaaagaaagggggcgccccttctaaagaatccaaaatttctttcccgtgcatgcaacgtaataacttttctatagggtcacctaaattaaattcactggc

SEQ ID NO: 82101 - DNA, 498 bp, Zea mays
  unsure at all n locations
  Clone ID: LIB3114-027-P1-K1-H11
tttactcctgcacgctcctcgcctacattttccttccggaattccctggtcgacccactcgtccgaaattatataaattacaaaaaaaacaatatttaaaaatccaancttaccaacaaaaacataaagaggacataaaaaaaaatataaagtaaaataaaatacaattcaatcaccaaaaatttaacaacataaaaaaataaaaaaaaaaaaaaggggccccccctttttaagaatccaattttatccccccttccttccacggcattatttttttttatgcccaccctaatttaatttcctgccccgtttttttacaccatttctattgaaaaacccccttttttcccaattttaattcctttaaaaaaaatcccttttttccacattttgtttttttaaaaaagcccccaactattcccccttttaaatttttcaccccctttttttaaattgttccccccctttttttgacatttttaaccccgtgtttttttt

SEQ ID NO: 82102 - DNA, 252 bp, Zea mays
  Clone ID: LIB3114-027-P1-K1-H4
aaaaaaaaaaaaaaaaaaaaaaaaaacaaaatataaataacaaaaaaaacgttctacaatatggggaaataaaatacgacgtacacgcgccttcataactgcttctttttttttaccttaacccaacttcctttccgtggctctacttttactaccctgcgaatgcccaaaccattccctttcccatctccttaatctacattcacatccccctttctcccactgtggtaattagaaaaacgccgatccccc

SEQ ID NO: 82103 - DNA, 292 bp, Zea mays
  unsure at all n locations
  Clone ID: LIB3114-027-P1-K1-H5
tgcacgctccggcgcctgattgtccggtcgacccacgcgttcgggcaccgcgctcgtgcccttccttaagttcggcggcaggttcgtcggcgacccccgggacgagaagatcgagaagatgctcaacgacctctccctcatcaagaagttcgagtagagcgggagcccncncttctcttatcttcttttctcttggaggagcgcgcatcctcagaggagggggattcaacatcaagacgacgggctgataaaattttacttgccctacactactatcgttgagggcacgtgc

SEQ ID NO: 82104 - DNA, 254 bp, Zea mays
  Clone ID: LIB3114-027-P1-K1-H7
gaatggcttctgttagaagtcctgctcggttcaattcaaccaagtatgagtatgacggtggagtctcgggggcttatgacatagatgcggtcaatgggttgagggaacggcagtttccctcgttggatagttactctaatggcctgtctgacgtgagtgcatcaaagccttggctgaatggctctcccaatccatcggtgatgagccttgggggtaacaacaattgataccacccccaaggttggggcctaccc

SEQ ID NO: 82105 - DNA, 295 bp, Zea mays
  Clone ID: LIB3114-027-P1-K1-H8
cccacgcgtccggactagcgttcggactagttctagaactcgagctagagctctagcggacgctctataagatacacgctcacgcacccgtacatgcgacgtattagctcacctatagtgaaacctatggccaattcactgcaccgtcgtgtacagcgaaaccactgcgaaacccatctcaatacccaagttaatcatcttgcattacatagctgttttaacagctggcaggacagcaaagatggccctaccgaacagccttgcaaactgaatggcaaacgggacgcgcactggg

SEQ ID NO: 82106 - DNA, 67 bp, Zea mays
  Clone ID: LIB3114-028-P1-K1-A10
aaaaaaaaaaaataaaataaaataaaaaataaaaaatttaaataaaaaaaaaataaaaaaaaaaggg

SEQ ID NO: 82107 - DNA, 100 bp, Zea mays
  Clone ID: LIB3114-028-P1-K1-A3
ttagcggacgctctagaggaaccaagcttacttacgcgtgcggggcaacgtaataggtcttctatagcgacacctaaattcaatgaactggcgcgtgtac

SEQ ID NO: 82108 - DNA, 279 bp, Zea mays
  Clone ID: LIB3114-028-P1-K1-A5
cgacggcacgctctgcggcccgctcgtcgacgacgcctcgctcgtcggcctgcgcaagaagaagcccgcgcgccgcctcatgcagctcctgtaagcgctgcttccacgtgcactacgcccggacggaccgcgcaagcgatggtgtaatacggctggtatgtgttttttggtttggtgtgtgcgtgcgtggtatacgcgtgccgtgcgcgccctgtggctgtggctgcagtggcgtcgcgttgggtgttttcttgttgtgacgaaaaaaaaagggtatgg

SEQ ID NO: 82109 - DNA, 62 bp, Zea mays
  Clone ID: LIB3114-028-P1-K1-A8
agcacacctaattccatgcgattcctcattcctaggctactcctcatacactaggggatacg

SEQ ID NO: 82110 - DNA, 61 bp, Zea mays
  Clone ID: LIB3114-028-P1-K1-A9
aacacacaaaattccttaactatctcttactctaactcaaataattaaaataattagggat

SEQ ID NO: 82111 - DNA, 313 bp, Zea mays
  Clone ID: LIB3114-028-P1-K1-B11
gggaggaggatgagacgcatgacccggatgtgcctgccgtttcccacatcaggggtttgtcaccctctgtgtttgttccgtttgaggaggctgatacttcggtgttaaacctccccgtggagaagatggactactacgtccctgggtgagctcttcatgacgacgatggccattggagaatgagatgatgggtggtcatgttacaagttaaaatgatgatggccaacgatctccttccctctcagatcccttgctggagcaaatgtgtaaatacagcgttgatttgtttacacttttgtggttgctcgcatgc

SEQ ID NO: 82112 - DNA, 427 bp, Zea mays
  Clone ID: LIB3114-028-P1-K1-B12
cagtggagctcaagaatgacttggcgatccgcgggacgctccactcggttgaccagtacctgaacatcaagctcgagaacacccgcgtagtcgaccaggacaagtatccccacatgctttcagtgcggaactgcttcatcaggggctcggtggtgcggtacgtgctgctcccgcaggacggcgtggacatcgacatcctccacgacgccaccaggagggaggcgcgcggaggctgatcctgatgcgcacccgctccctcacctgctggctgctgcttcatccccgattgtacgaagcatgcatgtacggtgtgtggtagacagatgccccaatttagttctttggtgcttgccttgacatagatattccaggttggatgatgacctgaatcacctgatatattattgtcatatcatatgcaatgttc

SEQ ID NO: 82113 - DNA, 60 bp, Zea mays
  Clone ID: LIB3114-028-P1-K1-C10
gtaaaaaaaaatataataaaaaaaaaaaaataaaaattatataaaaaaaaaaaataaata

SEQ ID NO: 82114 - DNA, 74 bp, Zea mays
  Clone ID: LIB3114-028-P1-K1-C2
tctagaggacccaagcttacgtactcgttcatgcggggtcattgctcttatataggggcacctagattcaattt

SEQ ID NO: 82115 - DNA, 171 bp, Zea mays
  Clone ID: LIB3114-028-P1-K1-C4
aagtctgcatagacaactgaccactgcttgcacgtttcgacagtctctgcactcggttgatcagcagctgagtctctaaatgagcccaccggcctcatctcactgtcaagcttacgcacatgctctccatgcgaaacttctacatcaggggcactaaggtgcgctacgtgc

SEQ ID NO: 82116 - DNA, 231 bp, Zea mays
  Clone ID: LIB3114-028-P1-K1-C7
acgcctgcagtaccggtccttaattgccgggcgcgtccacacttccatactatctctagatctcgatctacaggtttcaagcatacatgctcacttcacacgggcgatacggggtcctatatcttggcatctaactccatataacagtccgcctgctcactacgtacaaactggtaacacgcaagaccctcccgtcaccatacgtcattcaccacataccacattcgcctt

SEQ ID NO: 82117 - DNA, 80 bp, Zea mays
  Clone ID: LIB3114-028-P1-K1-C9
ctctaaaaataaaaaaaaaaacaaaaaataaataaatttcaaaaaaaaaaaaaaataggaaaaaggggaaaaattaaaaa

SEQ ID NO: 82118 - DNA, 221 bp, Zea mays
  Clone ID: LIB3114-028-P1-K1-D10
cttattgcaaaatctgaaaaaaaaaaaataaaaataataactaaaaaaaaaaataaaaaaaaaggaaaatggtcgcccgctctttgggacccacgctttctaacgcttgctttctacgatgttgcttttgtatggtgttacctatattcattatactggccagatctttacaacctcttgacgagaaaaactctgtctttatcccaacttaatctccttgc

SEQ ID NO: 82119 - DNA, 430 bp, Zea mays
  Clone ID: LIB3114-028-P1-K1-D12
ggcaccccaagattggggatggcgtgctgattggagcaggggccaccattcttggtaacgtgaaaattggtgccggggctaagattggagccggatccgtggtgctgatagatgtgccggcgaggagcacggcggttgggaaccctgccaggctgattggtgggaagaaggccgagggtgcgaatgaggaggacatgccaggggagtccatggatcacacgtccttcatacgtcaatggtcggactacaccatttgagagcggttatccaaggtctattgctcttcttttgtatcactagtaatggtgatgtaccaaataccgagtacttgctctttgttgtgtgctatggtttgtgtattgtacttagaagcctagtggtgtttatgatcattggcagctgagtgtgccatgcctgaatactggtaaat

SEQ ID NO: 82120 - DNA, 272 bp, Zea mays
  Clone ID: LIB3114-028-P1-K1-D2
gaattccctgcgatctctctaccctcgtctactagtttccccctaggggatcgtcgcataggaatcgcggagagggccgtctcatccgagttaaggaagccatggagcacaaggaggctgggtgccaggcccccgagggacccatcctctgcatctggtcagttctaaaatgatttgcatgttggctatgttgtgtaagctctatttatggtggtctcgctgagaaaaaaaaataaaaataatgctgatagttgttcggtgcaccgcatttg

SEQ ID NO: 82121 - DNA, 71 bp, Zea mays
  Clone ID: LIB3114-028-P1-K1-D6
caaaggatttgtaagatgtgaaaggagacatatcacatgctgaaaattcttgggggaaaaaaactggaggg

SEQ ID NO: 82122 - DNA, 307 bp, Zea mays
  Clone ID: LIB3114-028-P1-K1-D9
caaaggtggtggttttggcggtggcaagggaggtggtttcggcggaggtgcaggtggtggctttggaggaggcaagggtggtggttttggctgaggtgcatgtggtggcttcggaggtggcggaggttcgggtggtggcatttgtggtggactctataggtggcggtagcttcgcgcgcgcacgttgagtgcgtgcatgccatgaaattaaaaagcgatacatggagtgtgtggtacggtatggacattgctagagttacatttacatcatcactagtatatataaggttgacttttatttgtatgc

SEQ ID NO: 82123 - DNA, 403 bp, Zea mays
  Clone ID: LIB3114-028-P1-K1-E1
ccatgaccatcgagatgatgaataagaggcacaagattgagcgggacctgagtatctgcaagggagtcggatggtcaaagaaccagcaggtggctaaatccaaccccaccctcgctgcaatgaacaagaagtttgggatgatccacgggctgtcatcactggccaacatcatgttttttggcagcttggccatgcactcctggtacctggccagcaagctagagctgtgaagaaggggagacaagacgacacctttctccgccttgtcgtgaatcttgtcagttgtcacgatggtgttgcttgctgctcttataccagtttcaaaattggaataactagaaaatgggcagacacatacagacaggggtttgtaaaatcacactatctccgatcttgaatattt

SEQ ID NO: 82124 - DNA, 238 bp, Zea mays
  Clone ID: LIB3114-028-P1-K1-E10
gatgaacatgagctaagtagtcatcgtcatcgtcgcaatcaaattcgagacaagaagagaagagattttaattgttactgcatactactactacaacgtgcattcgagccgttgatcgatgaacactagtgcatgatcagcaatgtgtggatcatatataatgttattagctagtagagctagtgtactgttaaaaaaatttaaaatcttatttaaaaaagtaaaaagtttaaataaa

SEQ ID NO: 82125 - DNA, 217 bp, Zea mays
  Clone ID: LIB3114-028-P1-K1-E2
caagaaacatgatgggataacatttgtggtggaggactaaaaaaagaacatatctcattccggataccggtgacaagaccgctgggtgatcttgtccatgtttgtagtgaacaaccaacatgtaaagtgtcatgtagaaatgcgcatctgaggttcttgttcaaacttgtgtatcgggctttgttagaaccgaaatataggcaaaagtgcgcccctt

SEQ ID NO: 82126 - DNA, 398 bp, Zea mays
  Clone ID: LIB3114-028-P1-K1-E5
acctcgacttcgacctgagccagctggtgttcccgccggagatgacgtacctggacctgtcgcacaacctgatccggggcaccgtgccgctgtcgctggagcggctgtccacgctgcagaagctggacctgagctacaaccgcctgtgcggcccgctccccaagggacacggcgtcatcaagcacgggtgcaagccgtacgcgcacaaccagtgccgcaaagggaccccgctcgcgggctgccaggacctggagtggagtgagtgagccggccggtatggttttctatactctgctctgctctccctcgccggcgtgcttcccgatcgtggtgtgtgtaaggaactaaggacgacggggccctggtttaggcgtttagctatagacgaaagcccgtac

SEQ ID NO: 82127 - DNA, 55 bp, Zea mays
  Clone ID: LIB3114-028-P1-K1-E7
tacacacatacattttagaataaccactccttcaaatctactaaactaacttaaa

SEQ ID NO: 82128 - DNA, 57 bp, Zea mays
  Clone ID: LIB3114-028-P1-K1-F1
tccacgcgtccgaaggtttatgcgatgtggatttattattgtgcaatactaattaaa

SEQ ID NO: 82129 - DNA, 148 bp, Zea mays
  Clone ID: LIB3114-028-P1-K1-F12
aaaaaaaaaaaaattaataaataaaaaaatttaaatttaaaaaaaaaaaaaacaaaaagatataggggttattaaaaaaagggtggcgtcaatcttatattccctcctctcttctatcctttttgtcccctcttttttcttactttat

SEQ ID NO: 82130 - DNA, 185 bp, Zea mays
  Clone ID: LIB3114-028-P1-K1-F3
cccacgcgtccggcgagagcggccgaggcgctggcgttagggggtccgtcgcgtgcagctctgctcgagtgcgtcctatacctggtggcttgcgaaggcatggttaacgtttgaagtttgacgagtgtatttacttgtaataaaaaaccactaattttgtaagctttgttccagaaaatattcaa

SEQ ID NO: 82131 - DNA, 339 bp, Zea mays
  Clone ID: LIB3114-028-P1-K1-F4
gagaagatggcacttgactacatggatgttgaggctctcaagataacgaacaagaacaagaagcttgttgagatgcttgccaagaagtaccatgctttcttggcatcagaggccatcatgaagcagatatcccgtcttcttggtcctggtctcaacaaggcaggcaagttcccgaccctggttactcaccaggaatccctcgagtccaaggtgaacgagactaaggccaccgtcaagttccagctcaagaaggttctttgcatgggtgttgccgttggcaacttggcgatggaggagaagcagatccagcagaacatccagattagcggcaacttcctt

SEQ ID NO: 82132 - DNA, 128 bp, Zea mays
  Clone ID: LIB3114-028-P1-K1-F8
attggtttggccaaacacaaaactcatacttacctagttgaacataccctactctaaaaatggaccccgggggatcattcctccatatgcttggggcgccccctctaaaagtcccacgcttccgtacc

SEQ ID NO: 82133 - DNA, 413 bp, Zea mays
  Clone ID: LIB3114-028-P1-K1-G11
attaacacctccgttagcacgagctgcagggagggagttgggaggagaaacagagctaccggggcgatgggcaccgtgctcgattcgcacttcctggcgctcaccgccatcgttactgtggggtaccagctgctgttcttcatcatcacagctctcctccggttcgataaggtcaccgatttcgcaggcagtacaaattttatcataatcgccatcctaacattagctttgaagggagcatggcatttccgtcagattgtgctgacagtgcttgtcaccatttggggtcttcgtctaggattatttttattgatgaggattttgcaatggggtgaagaccgaaggtttgacgaaatgcgtgataatttggggatattagcagttttttggattttccaggctgtgtgggtttg

SEQ ID NO: 82134 - DNA, 249 bp, Zea mays
  Clone ID: LIB3114-028-P1-K1-G2
aacacatccttccatacaagccatcccacgcgagtatccaagattagagcaaatacaaccaggggctgggtgtaatttgggacggccaactgcttacacatcctgatcgccatcatcctgcctacgatgggggtgtaccttaagtacaggtgccgccacgagttctggatctgccttctgttcaccttcctcggatacatccccagtatcatctactccatttactccataaccaagaacacctatcat

SEQ ID NO: 82135 - DNA, 106 bp, Zea mays
  unsure at all n locations
  Clone ID: LIB3114-028-P1-K1-G4
gcgatctataacctatatcgcgagcggccccctggntgggggaatttttaaatttaaaatgacatatacatattatactattaattattcatataatcttatttat

SEQ ID NO: 82136 - DNA, 345 bp, Zea mays
  Clone ID: LIB3114-028-P1-K1-G5
agaagagaggtcatgtctttgaggagatgcagaggccggataccccgctctacaacatcaaggctttcgtgcctgtcatcgagtcctttggtttctccagccaactgagggccgcaacctctggtcaggcgttcccccagtgtgtctttgaccattgggacatgatgggctcagatcctttggaggccggctcccaggctgctcagctggtgctggatatccgcaagaggaagggtctcaaggaacagatgacccctctttctgagtttgaagacaagctctaaaatttttggcttgtggtgatactgtttcatctgccggtttaatcatcaattcgtctactgt

SEQ ID NO: 82137 - DNA, 54 bp, Zea mays
  Clone ID: LIB3114-028-P1-K1-G7
aaaacacatattcaaaatacaaaaatactatttataatcaaaaaaaaaataaaa

SEQ ID NO: 82138 - DNA, 367 bp, Zea mays
  Clone ID: LIB3114-028-P1-K1-G8
aagactcgataagttggaatgaattctggtctaatcctggacaaacgaacgggcccttaggcgtgcaataccagacgtagatagcataacgatagcacaatgcgcgattgtgccgaagtcatcagagaagagagaatcatagctgttagatgatatcaccaagtcttttgcacctacgtcttgtcagcgagaacattttgggttaagaacatgacagacttcctctgtgtgtaaaaactttgggcatacccccctcttctcatctacattggtgagattggtgtgtacatgctattgtagtacagagttcatacagagtgacacggttttcagagcagatcattagaccggtaaaaaaaaaaaaata

SEQ ID NO: 82139 - DNA, 394 bp, Zea mays
  Clone ID: LIB3114-028-P1-K1-H10
agagactttcgaaagctactgcttacagttggaggaagcactggttcttgttttggagagaccaattcaggtccaagaggccaacgtaactaaacacttgatttgtaacagcagcgccgatgagacttgcaaacacgagctcgggcttgaaaggtacagcagtcaggctgtccaagggtgtagttggtaaatgtgattgggcagatagttttgaaaaaagtgtatgggtccgagtattggtaattcttttatttgacatttaagttgttcagttggccttgtttagtagggccgttattctacttctctacaaagaacaatacacttgccaagaccaaaaaaaaaaggtggccgagattaattaccttattttaacgtcacggtgcgcggtttt

SEQ ID NO: 82140 - DNA, 175 bp, Zea mays
  Clone ID: LIB3114-028-P1-K1-H3
taataaaaaaaaataaaaaaacaaaaaaaaatataaaataaaaacttacaaacaaaaaaaaaacgactaaaggggatattatataaaggggcggccgatttaataggacccaaccttacttacccgtgcatgcgacgtattaatccttttatagggccacctaaattaaattgat

SEQ ID NO: 82141 - DNA, 240 bp, Zea mays
  Clone ID: LIB3114-028-P1-K1-H6
aaataaataaaaaatttatactttactaaataaaattttacaaatttaaaaaaacaaaaaataagagataaggggaaataataaaatgtctcctaggaatcaattcactcattcttaacttaacaatatatataatctaaaataaaaaaaggccccccctcttaaaaaaccaatttttactcaccccttctttcccctttttacttttttttttgttcccccatatttaacttccctccc

SEQ ID NO: 82142 - DNA, 377 bp, Zea mays
  Clone ID: LIB3114-028-P1-K1-H9
cacacccccagcccgccgacaccttactactagaaaccgatgcctaccataccacactgctggcagtctctggagcatttagggggactcgatcgatggaagaattgcgtcctagccagccggcaaaggtgacctgctgatgatgatgatgagaggcgagtcctacgccctaatcctactactaccctctttgtgtgctgccatacatccgtccccgctagacgatcgaggagagaataacgcatagctgtgtgctgccggcctctgtgttgtgccgcaccagccgcttaatttatagtctctactgtgagtgcgtccgatgtgtttagcagcagcataaggtgtattgcgcgggtatgtaatggtattgcaactat

SEQ ID NO: 82143 - DNA, 260 bp, Zea mays
  Clone ID: LIB3114-029-P1-K1-A1
aaaaaaaaaaaaaatataaaataaaataaaaaaaaaatttatttattaaaaatataaaaaaaaaaaagataaggattatataaataaataagtgtggttatattattatatattttattttttatttattttttatatttttatattttggggggggttttttttaagtgtttaaattttttttcctgtttttttagaataatttttttttttttgggtttataaaattaaaatttttgggccgtttttttaaaattttt

SEQ ID NO: 82144 - DNA, 210 bp, Zea mays
  Clone ID: LIB3114-029-P1-K1-A11
aaaaaaaaataaaataaaaaaaaaaaaatataaaaaaaaggaaggacgcatataggggagcctgggtgagctgctccaagctgcgtcggcatacttacttatgtagtggctcctcctattgagttacctggctgccgtttatcggccgtcggtctgcaacttccttgctgtgacccaccttactttttttgtagcaattgctttttttta

SEQ ID NO: 82145 - DNA, 71 bp, Zea mays
  Clone ID: LIB3114-029-P1-K1-A3
aaaaaaaaaaaaaaataaaaatttaataataataaaaaaaaaaaattataaataaaataaaaaaaggggaa

SEQ ID NO: 82146 - DNA, 105 bp, Zea mays
  Clone ID: LIB3114-029-P1-K1-A5
aactaaaaatagaatcgagagcggacgatctaagaggatccaagctaacataacacaagcatgacgacggcgtggcatattatatagtgtcgcctaaattcaatt

SEQ ID NO: 82147 - DNA, 325 bp, Zea mays
  Clone ID: LIB3114-029-P1-K1-A6
gacccatctcctctggtcgcccctaagcacctgttttgattgtggggacctagggagggggcaacggatgctcgattttgcttgattctagtctaggtagctcttgtggctgtatccatgagagagaccaatgtgtgtgtgaggatgaagaagacaagaagatactaggtacgacttgggccaaaaagaaaagataaaggttgtgttcagttaaaaaagaagctgatgagtccgtcagccatgtgcaaaaaaaaaagaatcttctctttgtttttttacattaaaaacaaaaaaaaatagagaatacggcgcgcgtatactagat

SEQ ID NO: 82148 - DNA, 342 bp, Zea mays
  Clone ID: LIB3114-029-P1-K1-A7
cgcaggtgtgaatgcctttgttgtccaaatattcctacgtgttggggtggtcgcttgctcgcgtccacgtctttcacatgaattggttactgtggtagttgtagttctggatacggcaccaaaacaaaagtattgctgtcaacaatttgcaacagccgggaaaacagtcgaaaacctttgcctataaaaaaatataattttattttttttcttcattaaataaatattattaaattaaaaacaaaattttcaataaatacaatttatataaaatcttaaaattattttttatatttcattattatattaattaacatcacaaaaaagggggggcctttttta

SEQ ID NO: 82149 - DNA, 351 bp, Zea mays
  Clone ID: LIB3114-029-P1-K1-A9
catcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttccttgccccagaacttgaaataaatatatatacgatgaaataacgcgggcatgccgaat

SEQ ID NO: 82150 - DNA, 391 bp, Zea mays
  Clone ID: LIB3114-029-P1-K1-B1
gtcctggaagtattgcgattctgaacacatttgataatgaaactaagtaataactatatggtgggaatgtaattttcttacatactgattattgaaatctctaaaggaccgtttggatggtcggtaatatttgagttctttatggttactaaaatataccataacatttaaagcttcaaggtgtttcgatacaacgatgtagttttacatccaattaccatgttattttgagttcttgaagaaaacctattcaaaactcattttcctcatttttttttaaaaatcaaagcacaacctcacattacctttggcaccattgagagttatgaagcatttggcctatcttattctcacgatttatgagtttttttcttttttgctttttttattt

SEQ ID NO: 82151 - DNA, 417 bp, Zea mays
  Clone ID: LIB3114-029-P1-K1-B10
cggacgcgtgggttttttttttttttttttttttttgggcgaacacccaagaccatgctgtatgaaacgattgtttttgtctagtctccagtgtaaataatggtacattgagcatgatctattcgagcagcttattaaggaaacatcatccgatacagaacaaacatcgcaaatcgaccacagtattagcgcaacatcctgcaatacagtacaatacatcacatcactagtcacgcctcattacgctactacactttcttcaagaggtggtactctgatatcgcgaaaccgaacgacgcaacgagcacgtaggcagcagcgtactattatgatacgtactagagctttcaggcgacgtgcagcgcgctaccgagcgcggcgcggaggctgtcgatcttgtcgccgggcaaaaccacc

SEQ ID NO: 82152 - DNA, 272 bp, Zea mays
  Clone ID: LIB3114-029-P1-K1-B11
ggaaaatcgtatttgcctccaaaaaaaaaaatattttgagcgaacaccaaaaaaaaaagatgaggggaaaagaaagaataagatgtagagcaacaaagaaaaaaaatgggacatttgggtgtgaattatttaatgtagctataattgggggggcgtctttcgattcattacttactttccccgtctttcactgtatttggcgcttctttttgtattacagttctggtcatttcttggcttttcactccttatttctcttcggcattttcttg

SEQ ID NO: 82153 - DNA, 253 bp, Zea mays
  Clone ID: LIB3114-029-P1-K1-B12
ctgtcgcctgcgtaccgtccgaattcccggtcgaccccgcgtccgaaaaaaaaaattttaataaattaatataatttaaaaaaaacaaacacaaaataaaataaaaaagggaaaaaataaataaagtgtaaaagtaaaaaaaattaaggggcgccctccttttatgggtcggccctctctttcgttggcttccttccttcctccctttcctttcgtgtctccttcttttattttttgcttcgtcttttttctc

SEQ ID NO: 82154 - DNA, 322 bp, Zea mays
  Clone ID: LIB3114-029-P1-K1-B6
agaggatatctaggtggttttggcaatgtatttagtgattttaaccattcaccctctaatgcaaaggaatacccccttgccttgccatcacgattattttgtcctctttctgttgccttggcaagtcaagattctacatatgcatattttaaaattgctggactcatgtatgctaaaaattgtacttatttacgcagttttgattctgttttatgcttaaaaaaaaaattatcttttactaaataaaattttcattaaaaaatataataaatataaattcataattaaaatatatgtttttttacttatacttcatactttt

SEQ ID NO: 82155 - DNA, 69 bp, Zea mays
  Clone ID: LIB3114-029-P1-K1-B7
aaaaaaaattaatatacaatctaaaaaaactaataaatgtataaaaaaaaaaaaaaaaaagggaggggg

SEQ ID NO: 82156 - DNA, 233 bp, Zea mays
  Clone ID: LIB3114-029-P1-K1-B9
aaaaaaaaataatttattattttaacaataaaaaaaaattaaaaaaaaaaaaaataaataagatgggggtgttataaaaatattattatataaatattaatataagttgacttctaattatattttctcaatttttcatattcttatatccttataatttttctgtggggggggtcttttttatttttcatttttttcctctctttcttctaattttatagtttttttttttt

SEQ ID NO: 82157 - DNA, 469 bp, Zea mays
  Clone ID: LIB3114-029-P1-K1-C1
cattcaaaaaaaataaaaaaaataataaattaaaataaaaaatatttaaaaataaaaaaaaaaaaaaataaggggcttattaaataaaatgttcctactttacatacccttgcttgcaatatttttacttttttttttgtccttaaattcaattttctggctttttttttccccttttttgcttttaaatccttgtctttacctcacttattttctttgcttaatcatctcctttctccccttttgtttttatcaactttctggccctctcccgttctgctcctttctaatctgtttgctccattttttttatgtgttgtatttgctctccctctcctcgtgctcggttctctttatactccctgttgcttttgttgtatttttacctcctcactcttgttccccctttacattttgtccacttgccccttatctcccccttttccctttttgcttttattttcccttt

SEQ ID NO: 82158 - DNA, 92 bp, Zea mays
  Clone ID: LIB3114-029-P1-K1-C11
tattaaaaaaattattcttttaaaaaacaaataaaaattaaaaaaaaaaatataaaaaaaaggggagggtaaaaaaaaaaacaatagcgtac

SEQ ID NO: 82159 - DNA, 401 bp, Zea mays
  Clone ID: LIB3114-029-P1-K1-C2
ggcggcggctacggcggtggcggcggctacggtggcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgctttttggtgctgc

SEQ ID NO: 82160 - DNA, 300 bp, Zea mays
  Clone ID: LIB3114-029-P1-K1-C9
aactcgaaaaaaacaaatcttattcataaacaaaatgggttcacagatatttctccatacgttcatgctcattgtggtagacgcagctgaccacctagagctgcatacttacttattcagactgatccagcatgtggcaacatcggaagttcacatgcttacagacgacaaattttcataacaatagcctggcttggctgcttcacagaataaccaaacgacaaccacgaaattgcgacgatataaaataaacaactcagaagcaaatcgaccccagaagcccgtcccacgcgtccggac

SEQ ID NO: 82161 - DNA, 244 bp, Zea mays
  Clone ID: LIB3114-029-P1-K1-D11
taataataaaatatataaaaaaaaaaacataaaaaaattaaaaaaaaaaaaaaaaaaaaaaaagggggaaaaaaaatggggcggtcgttttattggttcctttcttacttccccttgctttctccttctttgctttttttttgtgtctcctatttttagttccttggcctttctttttcatggtctttcctggttcccccctgccttttcccttctttttttcttttcttcccttccccctttc

SEQ ID NO: 82162 - DNA, 106 bp, Zea mays
  Clone ID: LIB3114-029-P1-K1-D5
cgctaaaaaaaaaaaaaaaagcaaacaattataaagaaaaaattttaacaaacgacgagcatacgacgtgataagctctactatggtgccacgctatattcaattt

SEQ ID NO: 82163 - DNA, 390 bp, Zea mays
  Clone ID: LIB3114-029-P1-K1-E11
cacagatgacaaaaggatccaggaggttccagcaatgaaggttactgccctgaggttcacggagacagcaagggccaggattgtcaatgctggtggcgagtgcctcacatttgaccagcttgctcttcgtgctccacttggcgagaacacggtcctcttgaggggccccaagaatgcccgtgaggcagtgaggcactttggcaaggctcctggagtgccgcacagccacaccaagccgtatgtgcgctccaagggaaggaagttcgagaaggctcgtggcaggaggaacagccgtggattcaagggttaaaacaaattgtggccctccgtgttgccatcagcatagtgcaaccgttgtgtttgatcagtcgacagtaattagtcatcact

SEQ ID NO: 82164 - DNA, 168 bp, Zea mays
  Clone ID: LIB3114-029-P1-K1-E12
aaataaaaacaaaaagatacaataaaaataaaaaaaaaaaaaaaactaaataaaaaaaaaaaagagagagaaataaaaaaaaatataagaaggtgctccatttctggtgcctccctttttggcgcaccttgctttttcgcgctcctcttgctgtatatcacgttccct

SEQ ID NO: 82165 - DNA, 68 bp, Zea mays
  Clone ID: LIB3114-029-P1-K1-E2
taaaaaaaaaaataataataaaaaacaataaaaaaaaataaaaaaaataaaaaacaaaaaaataaaag

SEQ ID NO: 82166 - DNA, 75 bp, Zea mays
  Clone ID: LIB3114-029-P1-K1-E4
aaaaaaaaaaaaaaaaaaaaaaaaaaaaaaaaaaaaaaaaaaaaaaaaaaaaaaaaaaaaaaaaaaaaaaaaaaa

SEQ ID NO: 82167 - DNA, 193 bp, Zea mays
  Clone ID: LIB3114-029-P1-K1-E5
atataataataaatataaaataaaaaaaaaaaaaaaaaaaaaatattaaaataaaaaacaaaagtgcgtaggaggataaaccattctagggggcgccctcttttaaggttccctgttcttctttctgcgccctcctgtttcaatacttttcttttggttccccacttaattgcctagctgcaccttctttttt

SEQ ID NO: 82168 - DNA, 361 bp, Zea mays
  Clone ID: LIB3114-029-P1-K1-E7
aaaaaaataaaaaaaaataaaaaaaaaaaaaaaaaaaaaaaaaaaaaaaaaaaaaaaaaaaaaaaaaaaaaaaaaaaaaaaaataaaaaataataaaaaaaaataaaaaaaaaaaaaaaaaaaaaaaaaaaaaaaataaaaaaaaaggggggggcctttttaggggatccaattttttttccgcgtttttgccaccattttttttttttttggggccccctaaatcaattccctgggccggcttttaacacctcctgtattggaaaacccttgggttctccaatttaaatttctttgcggaaaattctttttttcctcgcggggttaaaattaaaagggcccgccccctatccccttctca

SEQ ID NO: 82169 - DNA, 63 bp, Zea mays
  Clone ID: LIB3114-029-P1-K1-F1
aaaataaattattcttttacatataattctaacataaataacattaaaaaataaaaaaataaa

SEQ ID NO: 82170 - DNA, 393 bp, Zea mays
  Clone ID: LIB3114-029-P1-K1-F12
aagaaccgtgcgacgggcgcgtccatcgtggcgaggatcgtggaccagtgcagcaacggcggcctggacctggactacgagacggtgttcaagaagatcgacaccaacgggcagggctaccagatgggccacctcaacgtcgactaccagttcgtcgcctgctgagcaacagagctcagccagatccttcctgtgtatgtatgcatccatgcatgcaggcaggcagatgcagagaccgacgtcgttgtaaaacgcgtggccttacttgagatgaataaaacgcaacatgtagcgtcttgcaactgtcgcaagcacagctactactgctactgattaaataaacaggactgcaatgatagtaataaactatttaggcctcgttcgttttgaaaa

SEQ ID NO: 82171 - DNA, 396 bp, Zea mays
  Clone ID: LIB3114-029-P1-K1-F7
gattgtgcaggagtaattctctttgctgctgaaaatgcaacccaagttgcacttcaggcaatccagtgtcttggtggaaatgggtacataaatgagtacccaactggtcgtctcctgagagatgcaaaattgtttgagattggtgccggtactagtgaggtaagaagaatgataattggccgtgagctcttcaaagaggactgaaacttctattttgcaagccagatatcagagcatattgttagctggaggaggtgagggcgatttagatatttagcaaatcacccctgtggttcaatgcttttgtataaccgcagacatacatcaaataaagttcacttgtacttgctgcttgcagtggctctatttttctgtcaataaagttttttatgtcag

SEQ ID NO: 82172 - DNA, 83 bp, Zea mays
  Clone ID: LIB3114-029-P1-K1-F8
aaataaaaaataaattttactaaaaaaaaaaaaaaaaaacaaaaaaaaaaaaaaaaaaaagggggagggggaaaaaaagaaaa

SEQ ID NO: 82173 - DNA, 61 bp, Zea mays
  Clone ID: LIB3114-029-P1-K1-F9
aataatatcataaaaaccaaaaataaaaaccaaaaaaaaaaaaaaaaaaaacaaaaataaa

SEQ ID NO: 82174 - DNA, 310 bp, Zea mays
  Clone ID: LIB3114-029-P1-K1-G1
aaatataaaaaaatattatataaaaaaataaaaaaaaaaaaaaaaaaaaaataaaaaaaaaaaaaggggaggaaaaaacaacgtatggggggtctaaccctcaggccatggtcccagccggaggcttaacttccatgccggcgagcgccacgccttagaaaagctctacccgtggatcttgaggaagcacgaataagaggctaggctcactgtggctgaaataatgtctcatatccagcatgagatagactatgttggtactgatgcacatgtctccccaagagtacctcagcatcctcagattgcaaat

SEQ ID NO: 82175 - DNA, 438 bp, Zea mays
  Clone ID: LIB3114-029-P1-K1-G10
aaatataaatatattttttaataaataatttaaaaaattaaaaaaataaataaaataaaaataaaaggatataaataaatatatataataaaaataaaaatctttaatttaattataaaatatcattaatattttttatttaaaacttatgggggtgctccctttttaaggttcctttttttctttccccggtttcctttcttttttcttttttttatggctccttcaattttaacctttctcccccttttttcaacccgtctgctcttggaaaaccctccttgtcccctatttttattctctgttaaccttcccttttttcccagtcttgcatattcatttatagtcccccttttttcctttttttaaaatttttttctcttttttttgcttttgttccctcctttttcccgacctttttttcttttggtttttttt

SEQ ID NO: 82176 - DNA, 74 bp, Zea mays
  Clone ID: LIB3114-029-P1-K1-G11
ccaacacgtatctaataataaaaaaaaaaaaataaaaaaaatacaacggcaggggatcttatatagtgttagat

SEQ ID NO: 82177 - DNA, 410 bp, Zea mays
  Clone ID: LIB3114-029-P1-K1-G2
cacctctacgcctctctctctttccccgagctctcgaaaccctaggtgcgtgccgaccggcggcggcggcgaggtgatggcgatggacccggacgcggtggcgaaagccttcgtggagcactactaccggacgttcgacaccaaccgcgcggcgctggtggggctgtatcaggagacctccatgctcaccttcgagggccagaagttccagggcccatccgccattgccggcaagctcggatctcttcccttacaggcctgcgagcaccacatcgtcaccgtctactgccacccgggggggccccatggaggcatgctcgacttttcattggtaacatccgtaccggccccgaggagcacttcatcaagttctcttatgcattccatttgctgccggcagctgggtcctt

SEQ ID NO: 82178 - DNA, 429 bp, Zea mays
  Clone ID: LIB3114-029-P1-K1-G3
ggaccaaattggattaagattgggctttattcacattcatttttaaactaaaattaattgatagcctaacttattgtgagaaacatttgatttattaccacccctaactatactataattgcattttttttctgatttgatggagtattatctcattcatttgattgtttggaaaggttctttatcttcagaatccagacatctatcatcccttggtccggcgttctttggggtagggaatcttaaaagaatgtataaacagcctcttgaggtagtgcttgggacaggaaattgcgagttacctccatgacctcttcaatgcaccattgactgcattattgagaaggcagaagacatcattgatcggttggcacgtgcgaacttgcaatcgctttgacctaaaacaatatgccattattattgagaatt

SEQ ID NO: 82179 - DNA, 378 bp, Zea mays
  Clone ID: LIB3114-029-P1-K1-G9
aaatataaataaataaatatgcaaacaaaaataaaaataacaaaataacaaaaaaaaaaaaagcgaggaaaaaataaaaaatatagagtataccttaattcaattaaacagaacgaaattaataacaacataaaaactataaaaaaccctggggggcccccttttgagtaccctttctttctccccctcttttccccagttaatgtttttgttaattgcgccctatactatctccttcccctctttttcccaccctgtatggtgaaaaacccttgcccttccccagttcattatccgcggaccttgtcccccttttcgcgctgtgtgtcctttacacttgcctccgccctagcgccctttcctaacggtttctcccct

SEQ ID NO: 82180 - DNA, 443 bp, Zea mays
  Clone ID: LIB3114-029-P1-K1-H10
aaaataaaaaaataatataaattataataaaaataaatataaaaaaaaataaatataataaaagaaagagggatatttaataaaaaggggtgggttgtttttattgtttctcctcttttctttgttgttctttcttatttgttgcttctttatttctttttctctttttatttctttgtgcctttgcttattttttcttttttgctttactcttttttttcttatgtttctggttttctcttttttaacttttttccttttttaatttttaatgtttagtgctttttttttctctttcttttctttgttttttttgtttttctcttgtgagttcgttttttttggtgtatctctctctgattgtttttttttatttctttttcttcttttttaacttgttaggcgtctttcctctttatctatttattttgtgcttttttttt

SEQ ID NO: 82181 - DNA, 102 bp, Zea mays
  Clone ID: LIB3114-029-P1-K1-H12
agtaccgatacggaatttccgggtagacccacgcgttcgaaataaaaaaaaaaaaaaaaaaaataaataaaaaaaaaaaaaaaaaaaaatattaaaaaaata

SEQ ID NO: 82182 - DNA, 62 bp, Zea mays
  Clone ID: LIB3114-029-P1-K1-H2
aataaaaaaattaaaaaattataaaatatattaataaatataaataataatattaaataata

SEQ ID NO: 82183 - DNA, 296 bp, Zea mays
  Clone ID: LIB3114-029-P1-K1-H4
aaataaaaaatatataataataataataaaaaaaaaaattaaaaaataaataaaaaaaaaaaaaagggaaatgaaattttataataaataaaaaaataattttattaatttattttatatattattatatattttatatatattattatttttatttttataaatatttgtggggtttttttatttgttctctttttttcttctttttctttttcaacttttttttttttttttatgtctcttttatattaatttttttggttttgttttatttattttttattttttaaattttt

SEQ ID NO: 82184 - DNA, 74 bp, Zea mays
  Clone ID: LIB3114-029-P1-K1-H5
gactagttctagaaaaaaaaataaaaataaaaaaaaaaataattaagtatgaaaattcaaaacgaaggagggtt

SEQ ID NO: 82185 - DNA, 493 bp, Zea mays
  Clone ID: LIB3114-029-P1-K1-H7
aaaaaaaaatatatataaaaaataaataaaaaaaataaaataaaaaaaaaataaaaaaaaaaagaaagaggttaaaaaaaaaatttaaagataattaaaataaaatattataataatatatttttattttatttatataatagtttttttttttttttttttcttatttttttattttttgattttttattttttagttatgttttttttcttttttattttttatttttattttttttatattttatttattttgtttattttgtgttttgtaatgtattttttttttgtttttttgtattatatcttctcttttttttgtgtttttattttattattattctatttttgtattatttttattttgtctttattaacttttttttattttttgtttaattattttttattttattttttatttattatttttttattttctatcttttatttttttttccttttttttttgtattattttttactttttttt

SEQ ID NO: 82186 - DNA, 57 bp, Zea mays
  Clone ID: LIB3114-029-P1-K1-H8
tccacgcgtccgaaaaaaaataaaaaaatatattatataaaaaaaataatattaatt

SEQ ID NO: 82187 - DNA, 75 bp, Zea mays
  Clone ID: LIB3114-029-P1-K1-H9
aaataaataaaatttatataaataaaataaaaataaaaaaaaaaaaaaaaaaaaaaaaaaaataaggataaaaaa

SEQ ID NO: 82188 - DNA, 396 bp, Zea mays
  Clone ID: LIB3114-030-P1-K1-A10
aaaacgcatccgtaaaaaaaaaaaaaaaaaaaaaaaaaaaaacaaaaaataaaaaaaaatacaaggtgataaacacataaatagcaaacgtcataaactcatctataattaaacctattggtcggttcacttaccggttccttacttccgtcccctcttttaaaaccctatcttttcccaatttagtcccctaaatttaatatacctgctcgcggtttaacaccttttcgccaggaaaacccttcccttaccccttcttaacctttttgcaaaatatctctttttcgccactggccctataaccgaacattcccccccggttcccttttccaaacactttcccatcccgattgccaaatgggcccccccttgtacggtccttttaacccctccctt

SEQ ID NO: 82189 - DNA, 210 bp, Zea mays
  Clone ID: LIB3114-030-P1-K1-A11
aaaaaacatactaaaaaaaaaaaaaaaaaaaaaaaaatattataaaaaaaacaaaaatatataaaaaagtgcaaaattacatacgcgtgcctgtataaatatacctatttttataacgcttccttgcttcatttcacttgccttcttgtgtccccttttttaacttcccaaaccttgtctttacccaactttatcttttataaaaccctt

SEQ ID NO: 82190 - DNA, 387 bp, Zea mays
  Clone ID: LIB3114-030-P1-K1-A12
aaaaaaaaaaaaaaaaaaaaaaaaaaaaaaatttaaataaaaaaaaaaaaaaaaaaaaaaagaaaggggataaactccaatataaaaaatccaaactaacatacacttacataacaaataaaaacctattataaaggggcccccctttttaaagaatccaattttactttccctacttttcaactttttaactttttttttttcccccttaaattaatttttttgcccttttttttaaaacctgttaactgaaaaacccttggtcttccccattttaatctttttaaaaaatttccctttttaataagttgctttaataccaaaaagccccccccttatcccctttccaaacattgcccccccttaattgccaattttaccccccct

SEQ ID NO: 82191 - DNA, 266 bp, Zea mays
  Clone ID: LIB3114-030-P1-K1-A2
cggggtgtgtggcggcggcgattgtcctgtaaataccaagaattccgtccctttactggctcgtgcatgcagaactaatgctggtagctgccctgtgttgagcggcagctctgcttgttctagaagcttctgagaacatgtgtgggctatgttttccatgagattgtaagatgtgaggtggagccgctagaacacttagcgtgcgttttactgacagtgtggagtgctgctccttagttggaatagaaaaatgcaatttgatggcc

SEQ ID NO: 82192 - DNA, 246 bp, Zea mays
  Clone ID: LIB3114-030-P1-K1-A4
aaaaaaatatatcttcagaaattgacctataaaaacacaaaaattccatgcctttactatctcgggcatgcggaactaatgctggtggctgccctatattacaactacacctctacttgctctataagcttctgaaaacatgtgtagtctatctcctccatgaaattgcaagaaatgacgttgaccccctttaacacttaacctaccttttacttacagtacggactgcttctccttactcggact

SEQ ID NO: 82193 - DNA, 204 bp, Zea mays
  Clone ID: LIB3114-030-P1-K1-A6
ccaccggtccttaatttccggatcgacccacgcgtgcctaattataaaattttaaaaattttataataataaaaattatatattttataaaaaatatacaaaaacagaaatgggttaaatatataaataggtcaggcttatactaccccctccttttttatatttcacttatattctcctctctacctttctccctcttttttt

SEQ ID NO: 82194 - DNA, 356 bp, Zea mays
  unsure at all n locations
  Clone ID: LIB3114-030-P1-K1-A7
gaatcgattggcacccaggggggctggcgccttcctataccttttgattaacttctgagaaggggctcagacgacaacaaacgattggagagtccagtaaaaaatgaccctgtagtcctgtacttgtataacttctgcgaagtagaatgctgagtttaggctgctgtctggagtgctcctgtaccatatttttctggttttggatgaagctatatggaccaaattcatctctgttgaacaattgccaattacataacttgtgtttgcccaattccatggtgtgaaaaaaaaaaaaaaaaaaaaaaatatataaaataaaaaaatgtataataaaatattantttttataatttaat

SEQ ID NO: 82195 - DNA, 420 bp, Zea mays
  Clone ID: LIB3114-030-P1-K1-A8
aaataaattgaaacaaaaaaaaaaataaaaacataactataccttttgattaacataatggagaagtgtgtcaatactacaacgagcgatgggtagagtccaataaaatatgaccctgtattcctgtacttgtataacttctgctaagtaaaatgctgagtttaggctgctgtctggagtgctactgtaccatatttttctggttttggatgaagctatatggaccaaattcatctctgttgaacaattgtcaattacataacttgtgtttgcccaattccatggtgttgaccttatcatttattttaatttttatagctttttgttatttataatttaaccttttactttttatctattaactttttcccgagagcttccttgccccttttaattttcatatcttattttctcttttcc

SEQ ID NO: 82196 - DNA, 158 bp, Zea mays
  unsure at all n locations
  Clone ID: LIB3114-030-P1-K1-A9
cccacgcgtccgaaaaaaaaaaaaaaaaaaaaaaaatataaaaaaaaaaaaaaaaangggggagggtataaaaaaaaccaagcttacatacacattcatacaaaaaaaataactcttatatactgtaacctaaaaacaatgtggccggccgttttaaa

SEQ ID NO: 82197 - DNA, 112 bp, Zea mays
  Clone ID: LIB3114-030-P1-K1-B10
aaataaaaataaataaaaaagcgaacaataataaaaagaataacaagcttacatacacatagcgtgcggcgtaataagctgttctatagtgtcactctaaatttaatgtccg

SEQ ID NO: 82198 - DNA, 158 bp, Zea mays
  Clone ID: LIB3114-030-P1-K1-B11
gcggtagaacgttaagggcatgtggggaaacataatttttttagtatcaagataataccgtgatggcaacgactgctatacaagcagtctttctaaaaaaaaaaaaaaaaaaaaataaaaaaaatagaaaaaaaaaaaaaataaaaaaaaataaaaga

SEQ ID NO: 82199 - DNA, 414 bp, Zea mays
  Clone ID: LIB3114-030-P1-K1-B12
aagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctgagcaaccgccgggtccatagcaaaccaaccctgcatgcagggccagcttattatatataatatctgaggtggagcatatctatctggctgtgtactgcaagcaggcctagtacgccgcctgcgcgttcctcctattacacatataggcccctccctgcgtgtatgcttgttaccgtcgtgtcgaaccttgtactacgaggctccatcgaacatcgatggcttgcttctttatcagaacatgtttgaataaacgctatttggt

SEQ ID NO: 82200 - DNA, 368 bp, Zea mays
  unsure at all n locations
  Clone ID: LIB3114-030-P1-K1-B2
aaaaaaaaaaaaaaaaaaaaaaaaaaaaaaaaaaaatttttaattttanggaaaanaaaaaaaagtgannnggtgaaaaaaaaaaaaggggaaaagacaaacaaaaaaaataaaatggggggggtgttaaaaaggataaaaataaaataaggggaaaagaaaagaaaaaataaattaataaagagacaaaaaaaaaataaaaaccccgaaatggaacaactgccgacaaagaaaaaacccgcccacccacccaaaacaaacccccaaaaaaaaaacccccaattcacaagtggccaaaacacacaaaacgccaaaaacaacagcctctaccaaaaaaaaccacacccaaaaacaaaaaagaaaccccc

SEQ ID NO: 82201 - DNA, 371 bp, Zea mays
  Clone ID: LIB3114-030-P1-K1-B4
aaaaaaaaaaaaaaaaaaaaaaaaaaaaaaaaaaaaattaaaaaaaaaaaaaaaaaaaaaaaaaggggaaggaaaaaaaaaaaaaaaaaaaaaaaaaaaaaaaaaaaaaaaaaaaaaaaaaaataagggatgaaaaaaaaaaaaaaaaaaagagaaaaaaaaaaaaaaaaaaaaaaataaaaagggggggttgtaaaaaaaaaaaaaaataattgggggaaaagggaaaagagaaagtttgtatggggggaaaaaaaaaataataaaagggggtgggaaaaaaaaaaaggggaatgtaaaaaaatcattaagtaacaacaaaaaaagtggttaaaaaaaaaatgacttttagattggggggaaaaataaaa

SEQ ID NO: 82202 - DNA, 110 bp, Zea mays
  Clone ID: LIB3114-030-P1-K1-B5
aaaaaaaaaaaaaaaaaaaaaaagggcggacaaatataaaaagatccaaacttacgtacccatgcaggcgaggcaatatttcgttctctagcgtcaccatatattcaatt

SEQ ID NO: 82203 - DNA, 304 bp, Zea mays
  Clone ID: LIB3114-030-P1-K1-B8
aaaaaaaaaaaaaaaaaaaaaaaaaaaaaaaaaaaaaaaaaaaaaaaaaaaaaaaaaaaaaaaaggagaaaaaaaaaaaaaaatagagaaaaaaaaaaaaaaataaaaatgaacgaagataaacaaaaaaagagactggaaaaaaaactggcgtaacaaaaactaaatcaaaaggggggggcattcaaaaaaaaaaaagttggcgtaatggggaagaggcccgaaaacgattgtaattgggaacagaaaaacaaaaagaagggcgaatggtaaaaaactctgtagcagggaaaaaaccgcgggg

SEQ ID NO: 82204 - DNA, 286 bp, Zea mays
  Clone ID: LIB3114-030-P1-K1-C1
gtcccgaactcccatatcgacccacgcgtacgcgtccgaactaaaaataaaaaaaaaaaaaaaaaaaaaaaaaaataaaaaaaaaaaaaaaaatagtgggaggggttaaatttaaaaatggtgttctctccaaacaaaaaaacccatcctaacttaacttcttaattcttacgtcttatatttatctaaacccacacttaaattaaatttatattctcttcattttacaacttatattactataaaaacccttcccttccccaattaaatccctttctctcacatc

SEQ ID NO: 82205 - DNA, 452 bp, Zea mays
  Clone ID: LIB3114-030-P1-K1-C2
gcgagatcaacaagagcaacgcctactgcgacgcgagcaacaggcagtggccgtgcgcggcggggcagaagtactacgggcgcggcccgctgcagatctcgtggaactacaactacgggcccgccgggagggacatcggcttcaacgggctcgccgaccccaacagggtggcgcaggacgccgtgatcgcgttcaagacggcgctctggttctggatgaacaacgtgcaccgtgtgatgccgcagggcttcggcgccaccatcagggccatcaacggcgccctcgagtgcaacgggaacaaccccgcccagatgaacgcgcgcgtcggctactacaagcagtactgccagcagctccgcgtcgacccagggcccaacctcacttgctaggcgacggcgtccacgttgtacccatggctcctgctagtgctagctcgtccacaataaatgctc

SEQ ID NO: 82206 - DNA, 261 bp, Zea mays
  Clone ID: LIB3114-030-P1-K1-C3
acgagatcaacaagagcaacgcctactgcgacgcgagcaacaagcagtggccgttctcagcggggcaggagtactacgggcgcgggccggtgcagatctcgtggaactacaactacgggcccgccgggagggacatcggcttcaacgggctcgccgaccccaacagggtggcgcatgacgccgtgatcgcgttcaagacggcgctctggttctggatgaacaacgtgcaccgtgtgatgccccaaggcttccgcgccacca

SEQ ID NO: 82207 - DNA, 130 bp, Zea mays
  Clone ID: LIB3114-030-P1-K1-C4
aaaaaaaaaaaaaaaacaaaaaaaaaaaaaaaaaaaaagggcaatacatataaaaggacccaaacgggcgtgcgcattacatgcgacgggatgggtcttatatagtgtggcctcaatttaattaactcca

SEQ ID NO: 82208 - DNA, 438 bp, Zea mays
  unsure at all n locations
  Clone ID: LIB3114-030-P1-K1-C6
ccaaaaataattttttttttttattttctatttaaattttttctaattaacaaaaaaatanaacgccgcttatattaaaaacagggtgtgcgtcctcccccttacccaatttaaaccttttttattaagtcccctatattcaatttcccttgccatcattttacatcggcccccctttttaaaaccctccctttacccaccttaatcccctccctaaacattcctttttttccacctaaaataataacaaagagcccctttctaaacaccttttccaacaaaaacccccccttattcccaaataaacccccccctaaatatcccattatccccttcggttttattttttacacgcaccataacctttacctttcccaacaccctacccccctttatttaaatttccccccctccctttctcaccattatccccccttt

SEQ ID NO: 82209 - DNA, 497 bp, Zea mays
  unsure at all n locations
  Clone ID: LIB3114-030-P1-K1-C8
gactagttctagcccacgcgtccgaaaaaaaaaaattataaaaaaaaaaataaaaagagaaaggagaatcaaaataaaagatggtgtgcttactttactcattcttcctacatcttctcccttctttttatctctctcttttttcttttctcctccccttcatttaaataccctttctctcctttttaaaaacctttaatccttcctaaaatcatgtattctttcccctaccatttatttttttttcaactttatttcctttattaacacaattttccctctttttcttatttttccccatcaccatatttccccccttcaaaatacaatcctcacacccctctttttacaattccatcaacaccccctttggattttcatttattcctccccaccttntnctctttaaattttcaatatgacccctctccccctctccattttccctaactttccctttcctttctctttctcttccctcctctttttctcccctt

SEQ ID NO: 82210 - DNA, 73 bp, Zea mays
  Clone ID: LIB3114-030-P1-K1-D1
aaaaaaaaaaaaaaaaaaaaaaaaaaaaaaaaaaaaaaaaaaaaaaaaaaaaaaaaaaaaaaaggggggaagg

SEQ ID NO: 82211 - DNA, 224 bp, Zea mays
  Clone ID: LIB3114-030-P1-K1-D11
tgctgaactgatatgcttggtcttgtaaatgcggaacggtatgtacgcatgattgctggtgtgtatgttgctaagctgaaggcagctaaacactcaagtgtttgggtttgggctgtcttctgcggtcagtgtgaaataaaatgtaaatgtgtgttgttcaaaaaaaaaaaaaaaaaaaaaaaaaaaaaaaaaaaaaaaaaaaaaaaaggaccaaaccaatacgg

SEQ ID NO: 82212 - DNA, 443 bp, Zea mays
  Clone ID: LIB3114-030-P1-K1-D12
aactaaactaatatactaaaaaaataaaaatacaaaaaaaaaatatacacataaaaaaatggggtgggtattaaataagctgggaggcggctaaacactctagtgattgcgtttgttctgacttctgcggtcacttgttaaatacaaattgtaatatgtcgtgcttgttccattaaattaccacgtcttttacgtcaacacccttgttaaacccctggctttccccttttaacttttcctcctgtaaatccctctttatcccccatgttaccccccctctagccccctaccaatcacttttccaaacttatttgcaacctgctatggccattggaccccccccttaagtggcgcatttttcgttggatttgtcacctttacttctagccttaccaacccccttgccacgggatttttcccctttttttctccttttttccttc

SEQ ID NO: 82213 - DNA, 176 bp, Zea mays
  unsure at all n locations
  Clone ID: LIB3114-030-P1-K1-D3
atgaaacctttgtataactcaactgtacctctatctatcccttgtgtgtatttgagaacgatggcagagcatgtctggttcgggcgtctattanggcttgttcatttagctcttaatccatgtggattgagtcggattgaatgggtttgaatcacaaacaagtcaaacttcttttt

SEQ ID NO: 82214 - DNA, 376 bp, Zea mays
  Clone ID: LIB3114-030-P1-K1-D5
gatccgcatccagaagtggtacaacatctacaaggaccacatcacgctcaaggactacgagatccacgacgggatggggctcgagctctactacaactaggcgccctgaccccaaccgtgccctgatgtaaggttaatccgaattctgaagtcatgggtgcgcttccagtcacagcgtctttagctaacaagctcgcatacatataggcaacttgagtgagctatgtagtacggatatggttgtgtggcaaactgccaatgactattgacatccttgcatatattgacatgtgacaaggatcaacctgcaaaactggtgccctgctactcgcagaccttattatcttaaataacacaggtggtgtgtttttcaatt

SEQ ID NO: 82215 - DNA, 331 bp, Zea mays
  unsure at all n locations
  Clone ID: LIB3114-030-P1-K1-D6
gcgcaaaccccgccaaaaaatatgaacactttgtttcaaagcttggcagcttttatcgtttttaataatgagttctgttttcaataatgagttccggtaggatgtgtttttgccttcggtataaggtctcccatgttcattgcgcggctgagctcgttataaaaaaactaattatgtgaaaaaaaaaaacaacaaaaaaaaacaaaaaaaaacaaatataaaaaaaaaaaaaaactaacaaaaaacaaaagacacaccncggatatacgggtcctgtggtcacggaccaactcttccaaactggtgccttgtttcttgcacaccttataat

SEQ ID NO: 82216 - DNA, 188 bp, Zea mays
  Clone ID: LIB3114-030-P1-K1-D8
ccctcgcgttcgaaaaaaaattcataaacaactaaattaacaaacaataaaaaaacagggaaagagaaaaaaaaaagtggaggtccaagactatcaaaaaaaacaatcttctacccgcgtcactttttatttttctccttttgctaccctcacttccggtgattctgctgtaacctttggtaccataa

SEQ ID NO: 82217 - DNA, 298 bp, Zea mays
  Clone ID: LIB3114-030-P1-K1-E10
aaataaaaataaataaaaaaacaaacaatataaaaaaataacaaaaaaacaaacacacgcgggcggaggtctaaactattatgtacgggcaccccacttcatttctctgttctacggtcaccaacatccaatctcactaccaccctttttacaacccaactgactaaaaaaaccccaccttcccccatcttaaactcctttaataacaaaaaccttttttcagcatactttatataacagatacccaatcccatttccctttccaacactttttcaaactgaacattaaacgcgaccc

SEQ ID NO: 82218 - DNA, 202 bp, Zea mays
  Clone ID: LIB3114-030-P1-K1-E2
gctgtgtatctgatgaatccatgagacgatttctgctacgtttcttgcacgcttgtcgaacactgtgagactcacatcgcgctcatctacgctacgtgtaactgatactaatgatacggagtgttccaggtggtggtagatgtactgcagaatctatctcccatgtttcaataaacctgaataaggtgctcggtttggatct

SEQ ID NO: 82219 - DNA, 327 bp, Zea mays
  Clone ID: LIB3114-030-P1-K1-E5
cctttgtccaagaaaccaagcttcatcgaggagtgtttggcaatctttatggcaattattgacgaatggcggccatacttgcagcaccgtcaaatcgtgattgtactccatcttactgagcagagggtgaccttacgtttgtagcataaagtcctgctcaagctcattgacttgcattatcaaattcgcacaaacaggcaacggctgtaccgagcgactgatttggcacatatatatataagccgagacagtgggagaggagagctggacaacaggcaacgaattgtaattgaatcttctgaatactaaaggaaagcggtcacatcc

SEQ ID NO: 82220 - DNA, 100 bp, Zea mays
  Clone ID: LIB3114-030-P1-K1-E6
tctagaggatccaatcttacgtacgccttcatgcggcgtcatatctcttgtataggggcacctaaaatcaattcactggcccgtttttcaccacgttgac

SEQ ID NO: 82221 - DNA, 58 bp, Zea mays
  Clone ID: LIB3114-030-P1-K1-E8
aaaaaaaaaaaaaaaaaaaaaaaaaaaaaaataaaaatataaaaaaaaaaaaataaaa

SEQ ID NO: 82222 - DNA, 83 bp, Zea mays
  Clone ID: LIB3114-030-P1-K1-F1
aaaaaaaaaaaaaaaaattaataaaaaaaaaaaaaaaataaaaaaataaaaaaaaaaaaaaattgtgggggggcgtccattct

SEQ ID NO: 82223 - DNA, 419 bp, Zea mays
  Clone ID: LIB3114-030-P1-K1-F2
aaaaaaaaaatatataataaataaaaaaaaaaaaaaaaaaaaaaaaaaaaaaaaaaaaaaaaaaagggaagaggaaacaaacaaaaaaagggaaaaatacaacaactactttccaccttaaaataaattcactttccctcttttttcaatcccctttttataacacctctccttccccacccaactttttttccttgctcaccatccttccttccccacctcccttaccaacaatttctccccttttaaacccccttcccaacccccctttaccccttttaacaaaatcccctttctccccttcccctcattatatacaaaccctttccccatttcatttacaaatacccccccccctttattatccatttcccccccccctttaactccctttctaccccctcttccttttctttttc

SEQ ID NO: 82224 - DNA, 104 bp, Zea mays
  Clone ID: LIB3114-030-P1-K1-F3
ctgcagtacctgtcctgaattcccgttcgacccactcgtcctaaaaaataaaatatttaatattaaatataaaaaaaaattatttttcataaaaaaaaatacaa

SEQ ID NO: 82225 - DNA, 327 bp, Zea mays
  Clone ID: LIB3114-030-P1-K1-F4
agcaggtcgagcatcttcgacgccaaggccgggatcgctctgaacgaccacttcgtcaagctcgtctcgtggtacgacaacgagtggggctacagcaaccgcgtcgtcgacctgatccgccacatgttcaagacccagtagaggggttttttccccctgcttctcatggatggttgctgcttgtgtatgccgagaataaatgtggatggcgcgtgcctctgggtcgccaggttcatgctgagtctggacatgttttgcacttttgcttcccttcctgctaccatctgtgacagaaccgctcgctaatatgggacctgagattagctt

SEQ ID NO: 82226 - DNA, 151 bp, Zea mays
  Clone ID: LIB3114-030-P1-K1-F6
acctgcactaccggtttttaattcccgggccgcccgcactcgtccgaaataataatacaccaccccataaattccttctctactttatccatttctttaaaactgtgtggaataataaacttggttggggcaaaaaaaaaaacattacaat

SEQ ID NO: 82227 - DNA, 132 bp, Zea mays
  Clone ID: LIB3114-030-P1-K1-F7
aaaaataaatctatactccacaccataaatataactatctaactatatacattaactttatagctctgttattaaaataaacttgtgttgtgtcaaaaaaattaatttaataaaataatatactattttctt

SEQ ID NO: 82228 - DNA, 86 bp, Zea mays
  Clone ID: LIB3114-030-P1-K1-F8
aaaaaaaaaaaaaaaaaaaaaaaaaaaaaaaaaaaaaaaaaaaaaaaaaaaaaaaaaaaaagaagggaaaaaaaaaaaaaaaaaaa

SEQ ID NO: 82229 - DNA, 445 bp, Zea mays
  unsure at all n locations
  Clone ID: LIB3114-030-P1-K1-G11
agatcctcctcacctccaagggcatctccctcaaccccatcacctcgctctactacgtcgcgcgcctgctgcctcgctttcctcgtcgtgccctgggtcttcgtcgagctgcccaggctgcgcgccgtcggcatcttccagccggacctcttcgtcttcggcaccaactccctctgcgccttcgcgctcaacctcgccgtcttcctgctcgtcggcaagacgtcggctctcaccatgaacgtcgccggcgtcgtcaaggactggctgctcatcgccttctcctggtccgtcatccgcgacaccgtcacccccatcaacctcttcggctacgggatcgccttcctcggggtgggatactacaaccacgtcaagctgcaggcgctcaaggccaaggaggcgcanaagaaggcggcgcangccgacgaggaggccgggtcgctgctgc

SEQ ID NO: 82230 - DNA, 110 bp, Zea mays
  Clone ID: LIB3114-030-P1-K1-G2
aaataaatataaaatcataatctaacaatctaaaaaataacaaacttacatacaacatacatacggggtgggggctcttatatagtgtggcctaaattcaattcaactaa

SEQ ID NO: 82231 - DNA, 341 bp, Zea mays
  unsure at all n locations
  Clone ID: LIB3114-030-P1-K1-G6
cctaccggtccttaattccctgntcgacccacgcggccgacttccatacaatgttttttaggcttctgctgtgacatgtttaatcctgtacgatatattactgcacggtactatacttttgttggtgctgctaacgcataaatgttcctatcttttccctttctttataaatgaccaagttttgtctttcatttaatcgtagtaataaaaccctcctgtggcccattcttatatatattcttgtaatccttcaaagacatggttctgtcttaagtcccaacacctcacaattaccatattcagacattcaaaccaaaaaaatatctaaataaaaccaccct

SEQ ID NO: 82232 - DNA, 430 bp, Zea mays
  Clone ID: LIB3114-030-P1-K1-H2
aaaaaaaaaaaaaaaaaaaaaaaaaaaaaaaaaaaaaaaaaaaaaaaaaaaaaaaaaaaaaaaaaggagagggaaaaaaaaaaaaaagaaaaaagaaaaaaaaaaaaaaaaaaaaaaaaaaaaaaaagggggcgcccctttaaaagaaccaaagtttacttccccggccttccaacgaaaaaccttttttatggggcccccaaaattaaattccctgcccgcggtttaaaaacttcggaactggaaaaaccttggcttacccaaattaaatcccttggcaaaaaatccccttttcccaaggtgggaaaaaaacaaaaagccccccccctatcccccttccaaaaatttgcccaccctaaatggaaaagggaaccccccttttaccgccccataaaccccggcgggttgggggtttcccccaaggggaccc

SEQ ID NO: 82233 - DNA, 259 bp, Zea mays
  Clone ID: LIB3114-030-P1-K1-H3
ctgccgtaccggacttccattcccggccgcggcgacccatacactagctttcttcatgttttattaccactgggacccttttcagtgggcattttcaatgggctaggggctctggtcttgggaggctgcatcctgtaccacacctaaaacctgatcaagcgcctcacctacgacgagtacatctgaacgtcggttgggctgtacctcaacatcctgaacctgatactctccatccttaacatgctcaagagcatgcaat

SEQ ID NO: 82234 - DNA, 423 bp, Zea mays
  Clone ID: LIB3114-030-P1-K1-H8
ctagctttcttcaggttttcttcccactgggacccgtgtcggtgggcttgttcggtgggctaggggctctggtcttctcaggcttcatcctgtacgacaccgagaacctgatcaagcgccacacctacgacgagtacatctgggcgtcggttgggctgtacctcgacatcctgaacctgttcctctccatcctgaacatgctcaggagcatgcaatccgacaactagcctcttgatcgaacacggtatacccccatggtaaatgcggtcctgtgctctggttgttagaggacgggatcgacgtgcgacatatgtattgtgtgagcccactcgtgtcaacactgcaaacaattgtggtcatgtcaccttgtatgttcttggtcacttttcaaacaattgtaagtacctcatatcgttttgcgct

SEQ ID NO: 82235 - DNA, 239 bp, Zea mays
  Clone ID: LIB3114-008-P1-K1-A12
ccccttttcttttttcttctctttccatttccctctctttcccttcctttctcctcccttctctttcctcctctccccccttccctttcttttcttttttttctccctccttccctttttcttcctcccttctctctcctttccccttcacttccctcccccctctttcccctttccccttctctttccttcccttctcctttcgcttccttctgccccccccctcctcttttcccttt

SEQ ID NO: 82236 - DNA, 265 bp, Zea mays
  Clone ID: LIB3114-008-P1-K1-A2
taagagcaccggaaacgctggcggccgtgttgcttgtgggatcatcggactccagggctgaactgaaacaaatggtcgttggacttcgggggcgcctgggagtgccgtcaccagcaggctagaataacatcccgaagacatcgtgaaataataataataagagcgcctgatatgtgatcagtggtgtactcgccattaagcacctgtggcaaccgatgagctgaactgtgttggactgttggctaaaatgctggttcgcctgagc

SEQ ID NO: 82237 - DNA, 150 bp, Zea mays
  Clone ID: LIB3114-008-P1-K1-B1
cagagtcgacccactcgtccagtcttagttctagatgtggtagagattttctgaaagtcgaatccagtcaaaaaaaaatataaatcaaaaggaaattgtagaaaacaataggaaaataaaataaaaaaatatatataaaattacttaata

SEQ ID NO: 82238 - DNA, 105 bp, Zea mays
  Clone ID: LIB3114-008-P1-K1-B12
ctatatctctagctgctcgctctagagtatccaatcttacctacgcgcgggggcgacgtgataactcttctatagtggaatctaatttcatttcattggtctgac

SEQ ID NO: 82239 - DNA, 180 bp, Zea mays
  Clone ID: LIB3114-008-P1-K1-B2
ttcccaggtagacccacacgtccacccccccccctttttttttttttttattttttttaattttttttttgttttttatttatttaggggaaggaaaattatataatattttaataatatatatatattaaaaaaattacttaaataaaaaataattaatttaaaaaataaacataaaaa

SEQ ID NO: 82240 - DNA, 201 bp, Zea mays
  Clone ID: LIB3114-008-P1-K1-B3
taaaaaaaaaaataatattatataaaaaaacattatatttttttatttaaaataaaaatatataaaaaaaaataaaataaaaaagggggggccgttctaaaatattaatgtttaatttctcgtaaattcaatttaatagtttttttatagtgtaactaaaattaaattaactggccgtgtttttaaaacttttgtattgaa

SEQ ID NO: 82241 - DNA, 252 bp, Zea mays
  unsure at all n locations
  Clone ID: LIB3114-008-P1-K1-B7
agctagaggttgttactgtnncgtgcagtccgtatcttaattccggtcgcccatctttctccactcttcgaaaattaaaaaaaatttattttaaatataatatagaatataaagggggggttttttattttgagtactttttttttttccttattttactttttattttctttttgttttgttttttttttttttttttatttttttttatttattttcgttctgttttgtttttttttcactttctgtttt

SEQ ID NO: 82242 - DNA, 171 bp, Zea mays
  Clone ID: LIB3114-008-P1-K1-B9
cactctccgaaaaaaataaatataaaaataaaaaaatatattattataacataaaaaaaaaaatttatagaggataggggttcttatttatatgggaatttgatctctttttcttttattttaattatatcaattcaatttattcatttatatagtttatctatgtaattt

SEQ ID NO: 82243 - DNA, 167 bp, Zea mays
  Clone ID: LIB3114-008-P1-K1-C1
aaaaaaaaaaaaaaaaaaaaaaaaaaaaaaaaaaaaaaaaaaaaaaaaaaaaaaaataaaaaaagaaaaaggaaaaaaaaaaagggggggccgttttataggttccaattttactaactcgggcgtgctctgtcatagttcttttatagggccccctaaattaaatt

SEQ ID NO: 82244 - DNA, 291 bp, Zea mays
  Clone ID: LIB3114-008-P1-K1-C12
ctggtgttcttctgatcgggcctcgacacccagccgccgacggccgagggagcggcctgtacatagcgaagactcgaggtacaagtccataagcaccagcggtggtggcggcggccggttcggaagctctgaagctatagctaacagcacgcccgtgcatgtaggcccttccctgcccttggagaggcgagttcttcgccttccggcgcgtgaaccacggggggggcgaccgtgtgatttctttgaacgttttcgatccggcgattcattcgatcgcttaacacagccccc

SEQ ID NO: 82245 - DNA, 77 bp, Zea mays
  Clone ID: LIB3114-008-P1-K1-C2
aaaaaaaaaaaaaaaaaaaaaaaaaaaaaaaaaaaaaaaaaaaaaaaaaaaaaaaaaaaaaaaaaagaaaaggaaca

SEQ ID NO: 82246 - DNA, 274 bp, Zea mays
  Clone ID: LIB3114-008-P1-K1-C3
ccagtggataagagatataaggcaaatgctttcaggtttaggtttctacgcgtaagagattcccattctaatccaaggtttcagataggatcaattgatctatatgggaaaaccatatgaactccccccggagctgtgtttcacttttcggctttctgaactgctcggtctcacgagcctgtgtagtatcataaattcataatattgtaatgcgagcatttactgtggacgcaacgctctcttcagtatgaatagatactgaataattaagagc

SEQ ID NO: 82247 - DNA, 75 bp, Zea mays
  Clone ID: LIB3114-008-P1-K1-C4
aaaaaaaaaaaaaaaaaaaaataaaaaaaaaaaaaaaaaaaaaaaaaaaaaaaaaaaaaaaaaagaggaaaaaaa

SEQ ID NO: 82248 - DNA, 122 bp, Zea mays
  Clone ID: LIB3114-008-P1-K1-C5
aaaaaaaaaaaaaaataaaaaaaaaaaaaaaaaaaaaaaaaaaaaaaaaaaaaaaaaaaaaataaaggaaaaaaaaaaaaaaaaaagggggggggtgttttttttggggtcttttattttta

SEQ ID NO: 82249 - DNA, 401 bp, Zea mays
  Clone ID: LIB3114-008-P1-K1-C7
aaaggaactcgatcagagcacaacctcagacgatggagttgacacaaagaattgatcaactgcgtgttaggtgtgctcttcattgtacatagcgtgtgtactgttgtttttcttctctctctcctctttggagaaactgcttgtacatatgtatgtatggaccatgaagattattggtactgtatcaagtcactatccataaataaatacacgttggcctgcaaaaaaaaaaaaataaaataaataaaaaaaaaaaaataaaaaaaaataaattaaaaaaataaaaaaaaaataataaaaatcattaaatgaaatttatattattcaaataaatatcattcaattaaaatcaatctaattactttaatatcagggggtggccctttttaagggtccaattt

SEQ ID NO: 82250 - DNA, 364 bp, Zea mays
  Clone ID: LIB3114-008-P1-K1-C8
caagcatataataaaatgttttttatttattaattgtattttaatctcgttctctatggctgggatttccaatacttctagccactagaaagaggtacacccaatgctaggggctcccacatgagtgggttctaggcttctagcccataggtattaaggcgaccgacaccttttttatctttaggtgataaagcataaggcgaggcaacaccttaattatatctataaacattaaaatttagataaaatgttatttatatatcattaattcaaagttaataagcaagctagcacttttataaggcctagtaggcccaatttcagcctagaagcaggaaaaataaaatataaaaaatcataaaat

SEQ ID NO: 82251 - DNA, 426 bp, Zea mays
  Clone ID: LIB3114-008-P1-K1-D1
gactagttctagttttcgatcgaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaaaaaaaaaaaaaaaaaaaaaaaaaaaaaaaaaaaaaaaaaaaaataaaaaaaaaaaaaaaaagggggggggcttttaaaaaaaaaaaatttatttcttcggggggataaaatattattttttttttttgggggccaaaaaataaaattttgggggggggttaaaaaaatgtgttgatggaaaaaaccgggggggacccaaaaaaatagttttggggaaaaattctcttttccctaagggtgttaataaaaaaaaagggccctcacttattttctctctaaaaaaaattttgctctctttaaa

SEQ ID NO: 82252 - DNA, 197 bp, Zea mays
  Clone ID: LIB3114-008-P1-K1-D12
aaaaaaaataatatttaaatttaacatataaataacaaattaaattaattctaaattggggggcgggtctttttaaacccattcctacctccttcttatcccttctctatacttccaaatattaccataaatccaattttttggctctcctttttaaaattttaattctttgaaatccctttgtaaacccaatttat

SEQ ID NO: 82253 - DNA, 261 bp, Zea mays
  Clone ID: LIB3114-008-P1-K1-D2
cccacgcgtccgcccactctttctaaaaaaaaaaaaaaaataccataaacttattttcccccccaactataaatataaaaaaagaaaaaattttaccatcctatcaacccccctccttttccctccctccctcctttcacctttatctcctccatcttattctcctccccttacatttccttaacatttcttcttttcccactctcttatcttctcaattcccttcccatttctctttttattccttttttatctcttctc

SEQ ID NO: 82254 - DNA, 167 bp, Zea mays
  Clone ID: LIB3114-008-P1-K1-D3
gatgatggctgatggcggcgtcgtgtcctcccctggcctcctggggcgcttctggcgagcagtgtgtggggttgtgtgggtgccgcacgctagcaggctagccatgtgccctgctgtgttgtgtcaccatccatctataatcttatccataccccaccttttgtgtg

SEQ ID NO: 82255 - DNA, 280 bp, Zea mays
  Clone ID: LIB3114-008-P1-K1-D7
gctccgtgagcacaagggtgatgccgtggctgcggttcgattcctgctgcgctagttccgaggggtcgtcgccagcatcatatgttccccttcagttccacacaagaggtgatgatgtgaagtgaagcactagtacttttgtgtgcctgttttggaagtttgctattagaactatgttgcagaaaatttaagaatgagaataccatgcaaaaggtgtaatatgatttgtattagttatttgctattagaactaattaatcattatataaaaaaaaatatt

SEQ ID NO: 82256 - DNA, 155 bp, Zea mays
  Clone ID: LIB3114-008-P1-K1-E1
aaaaaaaaaaaaaatataaaaaattaatataaaaattaaaaaaaaacaaaaataaataataaaaaaaatggggggtcatcttaaatgatccaagcttccttacccgttcatatctatctcttatctctttctatattgtcacctaaatccaattt

SEQ ID NO: 82257 - DNA, 100 bp, Zea mays
  Clone ID: LIB3114-008-P1-K1-E11
cgcgttgggagttttcttgttgtgacgaacaaaaaagggtatgggttggggtggtgcgctgggcggcgcaccggggttttaatcaacttatattaacctg

SEQ ID NO: 82258 - DNA, 455 bp, Zea mays
  Clone ID: LIB3114-008-P1-K1-E2
taaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcgccccttttaaagaaccaaagtttacttcccctgccatccaacttttaattttttttttatggcccccaaatttaaattcctggccctcctttttaaaacttcttgcctggaaaacccctggtttcccccaatttaatccctttaaaaaaaatcccctttttcccattggggaaaaaaccaaaaaggccccccccaatcccctttccaaaaattttcccatcttaatgggcaattggacccccccttttaccgcccctttaaccccgggggttggggggtttccccccaagttacccttttctttttc

SEQ ID NO: 82259 - DNA, 357 bp, Zea mays
  Clone ID: LIB3114-008-P1-K1-E5
gcttctggcgagcagagtgttgtgttgtgtgggtgccgcacgctagcaggctagccatgtgccctgctgtgttgtgtcaccatccatctataatcttatccataccccaccttttgtgtgaaaaaaaaaaaaaaaaaaaaaaaaaaaaaaaaaaaaaaaaaaaaaaaaaaaaaaaaaaaaaaatggcggacgttaaaaaaaaatccatgcttaactgtacacgtacaatcaaccaaataaggttcattataggggggctgttattaaattcaatggccttttttcttaaatcgtcgagactatgaaaaccctggtcgttacccaaattaaattcgctgggagcctattcttctttct

SEQ ID NO: 82260 - DNA, 446 bp, Zea mays
  Clone ID: LIB3114-008-P1-K1-E6
agtacacgccgttcgtgtccatctacgggctggcgcagtgcacgcgggacctcgcgccgttggcgctgcgcgcagtgcctgtccacggcgctgtccatgttcggcgactactgcggcgcgcagcaaggctgtcagatcaactacagcagctgcagggtgcgctactagatctaccccttctacttcccgctcgccggaaagggcggtggcctcgccaccaccgacatgactaataacaccaagatcgtcgtgcgttcttaattagcctgaagtgacttgtgcgccttaacgtatggtaaagtagccttgcgttatctagcaataaagatgtgcaactgtatgtggttagagcttatgcagtggaatcacatctttgcgtctaagcactaggattgatatggtatacttaaaataaaattgaagggcgtgcgttttatgggatccaa

SEQ ID NO: 82261 - DNA, 58 bp, Zea mays
  Clone ID: LIB3114-008-P1-K1-E8
aaaaaaaaatataaaaaaaaaaaaaaaaaaaaataaaaaaaacaaaaataataaaaat

SEQ ID NO: 82262 - DNA, 185 bp, Zea mays
  Clone ID: LIB3114-008-P1-K1-F12
ggtcgacccacgcgttcgccctgtctccccgtagcaaggtgacactgacagacagttgcgtgcggtctggcgggggggcatgtagctcaagcaagacggctatgtacctctcacccttggcataaagacgtgtaaaggaaaacatatatatatactccccggcaagcaagatgtgttttttcaaa

SEQ ID NO: 82263 - DNA, 454 bp, Zea mays
  Clone ID: LIB3114-008-P1-K1-F2
ggcacattgctcgagcagtgctcgagagtatgtgttttcaggtgaatgatgtcctcagctccatgcacaaggatgctggagaggcaggagaagtaaagagcgcataaggagagttcttattgcgtgttgatggtggtgctactgttaataatcttctaatgcagatccaggctgatttattaggcagccctgttgtcagaccagctgacatagagaccacagccctcggagctgcatatgctgctgggttggctgcaggagtttggaccaaggagaaggtttttgcaggtttgcacaaggagaacacgacagtcttccgcccgaaactggatgaggcgcacaggaaaaagagggcggattcatggtacaaggcggtttcaagatcattcgatctggctgatctttctctgtaaatttatcctgccagcgctcctctatctggttttggaagctg

SEQ ID NO: 82264 - DNA, 215 bp, Zea mays
  Clone ID: LIB3114-008-P1-K1-F3
agctacccattggttcctgtgctcagcacattctatttgcagtccatctgtacctttggtccatatgatatactctgttgaaatgagtttttttctgagatggacgcgtacaggtgataaattgtaattggggggtgggtaaccgtgcatttatatgatttgtttgcatcatgttctgttaaataaacctgttgttatactaatattcataaatt

SEQ ID NO: 82265 - DNA, 450 bp, Zea mays
  Clone ID: LIB3114-008-P1-K1-F5
gagtttctcccctgttcttcaatcttgataacttgctctgcttttacactctgattctctcggactttttttagtccttggtactgttttcactgacatatattgatcagacatgtatgtaaatattacttcttgctcaaaaaaaaaaaaaaaaaaaaaaaaaaaaaaaaaaaataaaaaaaaaaaaaaaaaaaaaaaaaaaaaaaaataaaaaaaaaaaaaacaaaaaaaaaaaaaaaaaaaaaaaaaaaaaaaaaaaaaaaaaaaaaaaggggggggttcgttttaaagaataaaactttacaaacggggggtaacaaggtaaaatttcttttttaggggccccaaaattaaatccctgggccggtgttttaaaccggttgtttgggaaaaacctgggtggacccaattttaataggttggaaaaaaaacccctttttgcaggtgggt

SEQ ID NO: 82266 - DNA, 439 bp, Zea mays
  Clone ID: LIB3114-008-P1-K1-G10
aatcttataggttctcgaagatggtttcctccgagataacctctgttacagcagcgcgtgcacagggccccaagctttttagagggaagatacttctgccaggggggcccccagatgttgtgccttctgaaaatgttgagttcgacttttctgatgtttttgggcctagtgcagtccagactcacacagaagtgagtattctcactcctgacagtccaacacctgtggctgagtccaacgatgaggtttacaatgaccctgatgtcattgtcaaacgatctcattctcttgttggtccatcatctcttgttagccagtctttgccatttagcaagcttacattacacaagacagagagttcattggaactttcagagtgcccttccaaaggaaaacaaatcaaccaagggtcccttagcgatgatgagtttgatgatgt

SEQ ID NO: 82267 - DNA, 265 bp, Zea mays
  Clone ID: LIB3114-008-P1-K1-G11
gccctaagcttggtataggtaagatacttctgccatgggggccctcagatgttgtagccttctgaaaaagtcgagttctactcttctgatgcttttgggcctagtgcataccatactcacacagaatcgagcattcttcactcctgacagtccatcacctgttgctgtgttcaacgatgatgtttacaatgaccttgatgtcattgttaaactatcttaattacttgatgttcctatcattcttggaagccagtctttgccattt

SEQ ID NO: 82268 - DNA, 301 bp, Zea mays
  Clone ID: LIB3114-008-P1-K1-G12
gggcgccccacacttacatttttgctctctcgtgcgccttctatttctggtccgttctgcctcgacgcctttgcgggcgccaaccccttcgtgcagggcgattagctcaaggtctttgatcttgggagcttgaaccgtcgtctcttgcttcaagttcatgttttccccctctctgcggtactctccgtgagcttggtccaccgactgtcagaagggtccggtcgtcggattgtacgaatttcttccgtgttctctacgattggtgtaaaacccaagcccgtcggttcgtttgtgttaagct

SEQ ID NO: 82269 - DNA, 53 bp, Zea mays
  Clone ID: LIB3114-008-P1-K1-G5
aaaaaaaaaaaaaataaaaaaaaaaaaaaaaaaaaaaataaaaaaaaaaaaaa

SEQ ID NO: 82270 - DNA, 274 bp, Zea mays
  Clone ID: LIB3114-008-P1-K1-G6
aaaaaaaaaaaaaaaaaaaaaaaaaaaaaaaaaaaaaaaaaaaaaaataaaaaaaaaaaaaaaaagaggaaaaaaaaaaaaaaaaagggggggcgatttataagggctctcacttacaatcctcgttgaatgctacaggggacattttcggaaaagtgtaacaaaaatgaatttattcgcgctttattttaaaaacgttatggatagggtaaaacttgggggtttccaaattaattgggttgtaggaaaaattctttttagcagttgggcttat

SEQ ID NO: 82271 - DNA, 339 bp, Zea mays
  Clone ID: LIB3114-008-P1-K1-G7
taaaaaaaaaaaaaaaaaaaaaaaaaaaaaaaaaaaaaaaaaaaagggcggactatttgggaggagggaagcatacgaaaacgggggtgagtccttataatttttttataataggacgtaaatggattttacgggccgtttgtttacaatgggtggactgggaaaacgttggtggtacccatctaaatgatttttgaagtcattcgcttttatcaagttggtgtaatagtaaataggccaggtccgatctgtgattggaaatagtttagaatcctgaaaattaaatgggacgtactgttgaatgggtcattaaaatatgggtggattgaaaggatattg

SEQ ID NO: 82272 - DNA, 101 bp, Zea mays
  Clone ID: LIB3114-008-P1-K1-H1
acccacgcgttcgaaaaaaaaaaaaaaaaaaaaaaaaaataaaaaaaaaaaaaaataaaaaattaaaaaataaaaaaaaaaaaaaagaaaaaacaatgggg

SEQ ID NO: 82273 - DNA, 397 bp, Zea mays
  Clone ID: LIB3114-011-P1-K1-A4
cccccccccctttttttttcttttttttttttttttttttacacaaaaggtggggtatggatgagagtatagatggatggggacacaacacagcagggcacatggctagcctgctagcgtgcggtacccacacaacacaacacactgttcgccagaagcgccccaggaggccaggggaggacacgacgcccccatcagccatcatcatcattttagactcagagcatgccatggcacgcaactgactgactgacttgaaacacacacagggaccccgctttactttattaagctttataattagctagctttctccggccggcctgcaggggggagcacctaactcacttgccgcagttgcaggggtcgcactggcatttgccgccgcacttgcacc

SEQ ID NO: 82274 - DNA, 153 bp, Zea mays
  Clone ID: LIB3114-011-P1-K1-A8
aaaaaaaaaaaaaaaaaaaaaaaaaaaaaaaaaatatatattaaaaaaaaataaaaaaaaagaggggggaattataaaaagagaataataatattaaaatactataaaaataacaattattggggggccggtttttgagaaatccatttttac

SEQ ID NO: 82275 - DNA, 67 bp, Zea mays
  Clone ID: LIB3114-011-P1-K1-B2
gactcgctctgtttcggctcattaaactctgctggttgttggaggttactctctctgtgatcgttct

SEQ ID NO: 82276 - DNA, 53 bp, Zea mays
  Clone ID: LIB3114-011-P1-K1-B5
ggtagttgaagaagacggctagctagctgctgctgctgggctctctatctgtc

SEQ ID NO: 82277 - DNA, 219 bp, Zea mays
  Clone ID: LIB3114-011-P1-K1-C1
gcctgcagtaccggtcttgaattcccggctcgaccgcacgcgtccgatcaattgatgaacaatgtatgtatgaaccgaactgctcagctccgttgtgagcttatacatgggtgcggctaaaaaaaaaaagggggggggtgccctttttaaaggatccaattttacctccgcgtgcttccgacgtaatagttcttttattgtgccccctaaatacaatta

SEQ ID NO: 82278 - DNA, 437 bp, Zea mays
  unsure at all n locations
  Clone ID: LIB3114-011-P1-K1-C10
gctggtacgcctgcnagtaccggtcctgaattcccgggtggagcggcgcgtcctcaagaaaatgaagatgcacggcgagggccacgaccactactgcggccacagtatcagcggcggggacagcgactgagatctggtgtctcatcacaggtgcaacacatgtatgcttgctggatggaggattcataccagctgatgctgatgtagtgtttcactggtgtcatgcatgtatcgtgctattataatcaaaaagaaaaaagaaataacagtcagggatggtttgtttgccatgtgatcttgtacacttctacttaaattatggctgctgcacggtgctgctagcttgtactaataaagtgttgatctgcatgcttgcgtcttaaaataaaaaaagataattataaattgggcggccgctttataggatccaagcttac

SEQ ID NO: 82279 - DNA, 232 bp, Zea mays
  Clone ID: LIB3114-011-P1-K1-C12
gcctgcagtaccggtctttaattcacggggggaccgacgcgtctgaaatataaaaattaaataaaaataaaaaaattaaaaaaaaaataaaaaatataaaatatggggaggggatttataaaatatttagaggggcaaatttacttttaaatcaatctaatataataatttttatataaatatatttaaataaaagttactttacttatttttaaaacaatgttaatgtaaa

SEQ ID NO: 82280 - DNA, 53 bp, Zea mays
  Clone ID: LIB3114-011-P1-K1-D10
attcccgtgtcgacccactcttccgtactatcaatcaatctaaaatctaaaac

SEQ ID NO: 82281 - DNA, 332 bp, Zea mays
  Clone ID: LIB3114-011-P1-K1-D5
aagcctctagcataacatggctttgccgacctctgatgaatctgcctatcaggaggacggagagcaagatgacaaggagagcgagtatcatatatacattatgcatgcgtgtgccatggctaccttaagaagcgtatcgaggaggattactgatacctggttgacttactccagggaaaaaggggaagagaactagagaagaggcgggctcttaaaactggacaaaaatgactatttcaccttgattacataccatatctgttatggcctgtaaagtaaaaaaatcataaaacataaatagaggggcgccgttctaaaggatccaagcttac

SEQ ID NO: 82282 - DNA, 67 bp, Zea mays
  Clone ID: LIB3114-011-P1-K1-D6
ataaataaatttaaacttaataatgaaattaaaaatatattttaaaataataaataaaaaatggggg

SEQ ID NO: 82283 - DNA, 115 bp, Zea mays
  Clone ID: LIB3114-011-P1-K1-D9
acttactcgtgggtggggggatatatctgttgggtggtgtcacctatattcaatactcatgtcggatggtttacatcggcggcaattgggaaataccctgtcgttccccaactta

SEQ ID NO: 82284 - DNA, 72 bp, Zea mays
  Clone ID: LIB3114-011-P1-K1-E11
ctatatgatccaagcttacttacacttgcgggcgaggtcatagctcttgtataggggcacctaaattcaatt

SEQ ID NO: 82285 - DNA, 265 bp, Zea mays
  Clone ID: LIB3114-011-P1-K1-E12
cagcattttgtgttagctttgtcgtctacatgattcgtcactggctcaaggatgagtaatggacttcggagctgcaatgggagatggacagataggcatggtgattttggaaaagtgaatccgttccgattcttatcagaatcgcttgaaaaaatggtgacaaatgggttttggcggagcgattcacgagtggaacaattctcttttccttcagaaactctcggattggggaaaatgaagtttcacaccgattcctaatagtcac

SEQ ID NO: 82286 - DNA, 413 bp, Zea mays
  Clone ID: LIB3114-011-P1-K1-E7
gattcgaagcaagccggtggctctgctaaagctcctctagagtctgctgctgcgtccactgggttgccccctcatgcagacgtgtaccatctcggcatccagtcgcagcgctcggccatcgccagccagaggtctggacagctgcaaaggcccatccagaaatggaagggccctgacaagatcagcaggatctatggagactggatagatgagaacgaatagaagaaggatcttctacggtgggccgaagggaagctgttacttggtatccggccgactccacatcagctggtggaagctttacctggcttagaagatctcgttagcgctgcaaaaccagagttaagatcatcttttgcagacctgtattggggagataaactgctggaacatagtgccggtttcttccgttg

SEQ ID NO: 82287 - DNA, 134 bp, Zea mays
  Clone ID: LIB3114-011-P1-K1-E9
aataaaaatatattaaaaaacactaaaaattttatttattaaaataaatgggcccctcggggtaggggatccatgctaacgggggcttgctttctacttcataccttttttatagtttcacctaatttcaattt

SEQ ID NO: 82288 - DNA, 274 bp, Zea mays
  Clone ID: LIB3114-011-P1-K1-F10
tgactttttattctactagcagagctataatcgcgtaggtgaattattttttggggccgtaccatactctgctgttgctttagaatatgttattagtctgtcctagctcttctttggttacatgctttggttaaaaaaaaaaaacaaaaaaataataaaaaggggtggctttttaaataatccaaacctaacatacacgtccatacaacatcaaattttcttttatagattcacactaaatttaattgattggccgtcttttttacattctact

SEQ ID NO: 82289 - DNA, 403 bp, Zea mays
  Clone ID: LIB3114-011-P1-K1-F11
ctgcagtaccggtccgaattccgggggggggatacgtacggaccccatatgctgcgagccgaataagttttttggtcgcggtgcccgcgccatattgggggggtgctaccgttgagcgctcgggtgccctctcttgccgtaccgatgcctgtgttgtcccaacttgccagttcgatgcctgtacccgtggcttaattttctatcatcggagctacttatgtggttctataactagatgctgttttaccttcaacttgtgctgttgtaccttcatatttggactttttaagccttgtgtctgacgcctttggcattgaaatatgagagattttgtagactatctctgaagttatggggatctatatctagaggttgtttcagcttgttacttgtgttaatgaat

SEQ ID NO: 82290 - DNA, 335 bp, Zea mays
  Clone ID: LIB3114-011-P1-K1-F2
acgcgtccggttttttctcctatatagcgcaatatatatagaagattctctcttacgttctcacccatgcgaggtgatatttcttctatggtgatacatataaccaatacactgtcctccattttacaacatctgtactaggaaaacccactcattacctaactttatctccttacattacattcccctttcaccagactgctgtaatatctaataggcccgaaccgatcgaccttcccaacattttcgcatccttaattgctaatggtacactccctgtttccgctcattaaactcgatagttgttgatgttactctcagcttttccttttaca

SEQ ID NO: 82291 - DNA, 366 bp, Zea mays
  Clone ID: LIB3114-011-P1-K1-F4
tcctccaggtaccggtcctgaattccaatatcgacccgcccctcccatccacaacattttgtgatatcttccactatatacattatctcaaactaacttactcaaaacatacggcgtgagttaaaattatataatgactccttaacttcaatacactgtccctctttttacaacctcctcactgttaaatctctcacattccccaccttaatctcctcccttcacatcctcctttaatcagcttgcttattatcctatagccccttcaccaatcacccttcccaacacttactcacccttcatgaccaattttactccccctgtatccacacattattctcctcttctgcttttttacactcattt

SEQ ID NO: 82292 - DNA, 410 bp, Zea mays
  unsure at all n locations
  Clone ID: LIB3114-011-P1-K1-F6
agctgcgaacaaaaaccttgctcattcttctctcgtctcgtttgatagcgggagcaaccaaagcgaacaacagggtaccaacacctaatccaaaggtagaacggacactaacacggtgacagaagcgaacggtaacacgatactatagatagataagataactcggccgaagccaggatgggcccacacataagtcccttcagccgccgccgncaccgccgccgtagccgccaccgccaccctcgcgccgaccgccgtagccgcttcaaaggatgtgaaaaacagaatgttcattctgttctacttcaggaaaaaggaaaaaagtaaggtggcgaagagcatcgattggccacagctgaaaccgtgcttgtacaaacggcgatgagccgtttgtctcgtatccaccagaa

SEQ ID NO: 82293 - DNA, 224 bp, Zea mays
  Clone ID: LIB3114-011-P1-K1-F7
aaaaaaaaaaaaaaaaaaaaaaaaaaaacaaaaaaatattaaataaaaaaaaatataaaatgggggggtaaattatagcaacctgggtggaatctcaatgatatctacccctttttctcatgtttaacgtacacttacttggtgtccgaagctaatcggtttgcttttctttacctatatctaatttctttggctttgtctgtattgtcccatacttctgtttt

SEQ ID NO: 82294 - DNA, 423 bp, Zea mays
  Clone ID: LIB3114-011-P1-K1-F8
cccacgcgtccggcgccaagctgaaggccatcaccgaggcggagctcaactacccgtcgctggtggtgaagctgctgtcccatccgatcaccgtccgccgcaccgtgaccaacgtcgggaaggccaactcggtgtacaaggccgtggtggacatgcccagggccgtgtccgtggtggtgcggcccccggtgctgcggttcgccagggcgaacgagaagcagagcttcaccgtgacggtgcggtggaacgggccgccggccgtcgccggcgccgaggggaacctgaagtgggtgtcgagcgagcacgtcgtccggagcccgatcgttataccgccggccaaggccgccgcgtaggcgtaactcccaatccaatctgcttgacggccggcaggaccgttctcagctcgtgtcgtgtctccgagga

SEQ ID NO: 82295 - DNA, 118 bp, Zea mays
  Clone ID: LIB3114-011-P1-K1-G1
taaaaaaaaaaatattaaattatttaattaaaaaaattaaaaaacaaaaaatttctctctcatcgtggggggataaaaaaaaaaataaatcatactacaaatattttaattaaatttt

SEQ ID NO: 82296 - DNA, 106 bp, Zea mays
  Clone ID: LIB3114-011-P1-K1-G4
taataaaataaaaacaataagcaatcactctaataaaaaacaaacaaacatacaacatacatacggggaaataaaataatatatagtgggacgctaaattcaattc

SEQ ID NO: 82297 - DNA, 391 bp, Zea mays
  Clone ID: LIB3114-011-P1-K1-G5
taataaaaaaatattaataaaatatatatcacacaacttcaaaaaaaacaaaaaactcacaaacggggggagaactattaataaaaggattccgtacattcactaccctataccttaaatcaacatcataaataattataatgtgccccctctttataaaaactaaaatatcataccctacaatccccacttttaattttatcttttatccccccaaaatcacttctctctcccttcttaacaaactctcctttttaaaaaacccttttaatcccccataaaataccctttaaccacctccccctttttcctacctccaaaaatacaataacacccacccttatcctttttcacacaatttctcaatatctaaaattaatttttccccccc

SEQ ID NO: 82298 - DNA, 294 bp, Zea mays
  Clone ID: LIB3114-011-P1-K1-G8
acgcctcccaggtaccgtctctgaattcccggctcgacccacgcttccgataataaaatttattataaaaaatcaaaaatattcaataaaaaaaaaaataacaattagggggggggttaaataataaataatgaggtggcctctttttaagattccatctttccattcttttgcatccaatcttttacctctttttttttgtaccccaattccaatttactggcctatttttaacacctttaatacttataaaaccctttctttacctaattaaatctccattcatctcattcc

SEQ ID NO: 82299 - DNA, 73 bp, Zea mays
  Clone ID: LIB3114-011-P1-K1-H12
tctataggattcaagcttacgtacgcttgcgggcgggggcatatctattctatggagtgacctaaatacaatt

SEQ ID NO: 82300 - DNA, 197 bp, Zea mays
  Clone ID: LIB3114-011-P1-K1-H3
atcctaatcatgaaatactctgatttggcgtggctttgggaatctgagtgaatgtacatagagtgggcagcgcattgtgcgccatgtcgagttaattgaactaacctgcaatgttgaactggctggatgttggattgtgcgcatcgttgcaaccgtgaaactgacgttttttaaaaaaaaaaatatagaaataatta

SEQ ID NO: 82301 - DNA, 330 bp, Zea mays
  Clone ID: LIB3114-011-P1-K1-H4
ctgcagtccggtcctgattccctatcgagccaggcgttcgaattaaaattatatttattaatataataaaaaaaataattatattaaaaaaataataaaaaaaagggaggagataaaaaaataaaaaaatgaaggaaaaaataaatctattataaaaaaatataaataaaaaatatataaaataaataaataaaatggggggggctttttaaaaagatttttttatattctcttttttataaaataattttttttttatattgttcccataaataaaatttatctgctagttattaaaaatttttttcattaaaaaatactttttttttt

SEQ ID NO: 82302 - DNA, 375 bp, Zea mays
  Clone ID: LIB3114-011-P1-K1-H5
aaaaaaatatatataaattaataaaaatataaaaaaaaaaaaaaaaaaaaaaaaaaaaaaaaaaggggaggggaaaaaaaaaaaagggggggccgttttaaaatatccaattttccatcctcttacttgcaacctcttactttttctttagagttcccaaattccaattcactgccccttattatacaacgttgtatctggtaaaacccttgcttttcccaacttaatttccttataacacatccccctttcaccatctggctaaataaaaaaaaggccctaacctatctctcttcccaacaaattctcatccttaattggtaaattgaacccccccttttagggcccatttaatcccccctctgttttattttt

SEQ ID NO: 82303 - DNA, 365 bp, Zea mays
  Clone ID: LIB3114-011-P1-K1-H8
actagttctgatcgcgctgggaggtgggaacattcactgcatcacgcagcagcagcccgtgcgcccgtcctagctgaaaccggcgtcgacgcgaggggcgatgaagagcttgcgagtagtattgttttgtatgctgctcctgtcgttatcacgctcaccaatacgctcgcgaaataagccacgccagcagttcgttgacacatactgtatgagtactattatactatacggcacaaacggccaaacgccacacaggcgtggatcaaaattgtactagttcctgtctacaattcgtggcctttatcatcctgattggctgcccgtatattatttatcttaagtcatctatattcttatcttaagtc

SEQ ID NO: 82304 - DNA, 262 bp, Zea mays
  Clone ID: LIB3114-011-P1-K1-H9
gactagttttatatcgcgagcgggcggtctcaaggattcaagcttacatacgcatgcggggggcgcgatctatctgatatcggggcacctacaaggagcgaacaagacgttgttagacatcttggtgactgtgctaaccctgtcgttaccacacttactaatccggtagcaaaataagcttcgcccagctggcgtagtcacaaacaggatgggacctatcgtcctatacagcacaaacgcacactcgatggacaatgggaca

SEQ ID NO: 82305 - DNA, 238 bp, Zea mays
  Clone ID: LIB3114-015-P1-K1-A11
aaaaaaaaaaaaaaaaaaaaaaaaaaaaaaataaataaaaaaaaaaaaataaaataaaaggggggggagagtaaaaataagagaaagcaacccataaaacaacaaatcatttagggggggggccttttatagggattcaggggtctggccttttgaatgcaacgttttgtcttctttttggtgtcccctaaattaatttatgcggccgttttttataccacttgtttattgggaaacc

SEQ ID NO: 82306 - DNA, 177 bp, Zea mays
  Clone ID: LIB3114-015-P1-K1-A2
aactaaaaaataaaatcaaaagcgaacaatataaaaagataacaagcttacatacacatacagggggggaaataaaataatataaaaagtaaggtcggcccttttcactggccgtggtttcacaccgttgcgtctggcaaaacaccttttgtttcgcgtctcataaatctagtacaa

SEQ ID NO: 82307 - DNA, 335 bp, Zea mays
  Clone ID: LIB3114-015-P1-K1-A3
cccacgcgtccgggcaaaggtgacctgctgatgatgatgatgagaggcgagtcctacgcgctagtcctactactaccctctttgtgtgctgccatccatccgtccccgctagacgatcgaggagagaataacgcagagctctgtgctcccggcctctgtcttctgccgtcccggccgtttaatttatagtctctactgtgtgttcgtcccatgtgtttagcagcagcagcaggtgtattgtgcgggtatgtaatggtattgcaactatattgggtgtaaaaccataataaatgtggaaaaaatgcaaggaaaaaaggcttctactgtttacactt

SEQ ID NO: 82308 - DNA, 284 bp, Zea mays
  Clone ID: LIB3114-015-P1-K1-A4
cgggtcgaccacgcgtccgaagggcggccaagttatcctgttcgctaccgtgatgtttaccctagtccagagggtttatgttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 82309 - DNA, 135 bp, Zea mays
  unsure at all n locations
  Clone ID: LIB3114-015-P1-K1-A5
gtcctaattctcnttcgacccacgcgttctaaaaaaaaaaaaaaaattattattttaaataatttttataaaaaaaaaaaaaaataaaaaagagggggataattaatagttatgttttaaaataatttaaaatta

SEQ ID NO: 82310 - DNA, 315 bp, Zea mays
  Clone ID: LIB3114-015-P1-K1-A7
aaaaaaaaaaaaaaaaaaaaaaaaaaaaaaaataaaaaaaaaaaaaaaaaaaaaaagggggaaaaaaaaaaaaaaaaaaaaaaaaaaaaaaaaaaaaaaaaaaaaaaaaaaaaaaaaaaaagggggcggccgttttaaaggatccaagtttccttccccggccttgcaaagtaaaagtttttttttggggcccccaaaattaatttaatgggcccgcttttaacaccctttccaatggaaaaaccctctggatccccaattaaaccccctttggaacaacccctttttccccggctgggtaatagataaaaaggc

SEQ ID NO: 82311 - DNA, 323 bp, Zea mays
  Clone ID: LIB3114-015-P1-K1-B10
cgaatttcctcgtccaggccggcattgtgaagaaggagcacatcaagattcatggtttcggagcaaccgccgggtccatagcaaaccaaccctgcatgcagggccagcttattatatataatatctgaggtggagcatatctatctggctgtgtactgcaagcaggcctagtacgccgcctgcgcgttcctcctattacacatataggcccctccctgcgtgtatgcttgttaccgtcgtgtcgaaccttgtactacgaggctccatcgaacatcgatggcttgcttctttatcagaacatgtttgaataaacgctatttggt

SEQ ID NO: 82312 - DNA, 472 bp, Zea mays
  unsure at all n locations
  Clone ID: LIB3114-015-P1-K1-B12
ctgcggtaccggtccngaattcccggggggacgcacgcgtccgcccacgcgtccgcgcttcaccatccctaaggcctgccgcacgaagcccgccgcggcggcgggtgtgaagccggagaggagcggcggcgaggacgacgccgagtcagaggcgatggccgaggtggctgccgcactgcggtccgtcggggaggggttccttcgtatggaggagcgcaggctcgagctgtcgcttcagatggagaaggaacgaatggagtcagagatgaagcgcacccagacgatgctcgacgcccaacagctcttcctcgaggccttcctgggtaagcagcagcagcagcagcagcacaagaaggccagggtctccccttcctctgccgcaatggaagaggactgatcaatccatgtagcccggttgctctagttctgctctgtcaaccttgtgtgcatccttcctcgctctgcgttgact

SEQ ID NO: 82313 - DNA, 66 bp, Zea mays
  Clone ID: LIB3114-015-P1-K1-B4
acgcgttcgcaataaaaaataaaaaaaaaaaataaaaaaaaaaagattgcttcattacttacaaaa

SEQ ID NO: 82314 - DNA, 298 bp, Zea mays
  Clone ID: LIB3114-015-P1-K1-B5
aaaaaaaaaaaaaaaaaaataaaaaaaaaaaaaaataaaaaaaaaaaataaaaaaataaaaaaggggaaaaaaaaataaataaaaaaaaaaatataatatataaatatataatttactgtttaaaatattagtttttattaaatttttaattattttacttgttttattctaaataattaattaaatgattatttaaattaattaatctctaatattttataccttactattttatttattatatctttttaatattattcttaatatattaattatatattatattattagatgata

SEQ ID NO: 82315 - DNA, 252 bp, Zea mays
  Clone ID: LIB3114-015-P1-K1-B6
cggcgggggggtttaaacccgagaggggcgggcgccaagaccacccccaatcaaaagccatggcccagggggctggcgcactggggtccgtcggggaggggttccttcgtatggaggagcgcacgctcgagctgtcgcttcagatggagaaggaacgaatggagtcagagatgaagcgcacccagacaatgctcgacgcccaacagatctttctctaggcccttctggggaagcagcagcagcagcagcagc

SEQ ID NO: 82316 - DNA, 98 bp, Zea mays
  Clone ID: LIB3114-015-P1-K1-B9
aaaaataaatataaattaaaataaaaaaatattaaataaaataaaaattaaaaatttggggggggttaatttaaatggggggcctcctttttggtttt

SEQ ID NO: 82317 - DNA, 309 bp, Zea mays
  Clone ID: LIB3114-015-P1-K1-C1
aaaaaaaaaaaaaaaaaaaaaaaaaaaaaaaaaaaaaaaaaaaaaaaaaaaaaaaaaaaaagggggaaaaaaaaaaaaaaaaaaaaaaaaaaaaaaaaaaaaaaaaaaaaaaaaaaaaaaaaaaaaaaaaaagggggggccctttttaaaggaccaaatttaacaacccctggcttgcaacaaaattttttttttttgggggccccaaatttaaattacctggccggggtttaaaaacgtctgaactggaaaacccttgggttaccccaattaaatcccttgggaaaaaatcccctttttccaaggggg

SEQ ID NO: 82318 - DNA, 298 bp, Zea mays
  Clone ID: LIB3114-015-P1-K1-C10
ggtttggtaaaaaaaaaaaaaaaaaaaaaaacaaaaaaaaaaaaaaaaaaaaaaaaaggggggaaaaaaaaaaaaaaaaaaatttacctatattaaaaataaattaaaaaaaaaattatataaaaaattaaataataaataatataagggggggccccttttatgggccccaagtttcccacccctcgcttcccacttttaattctttttttattggccccccaattaaatttctttgccccggtttttaccacgcctttctttgtaaaactttggcttttccccaatatatttcttt

SEQ ID NO: 82319 - DNA, 432 bp, Zea mays
  Clone ID: LIB3114-015-P1-K1-C11
gtaccggtccggaattcccggggggacgcacgcgtccggactagttctagctcgccatcgactgctccgcgcagcaccccgacaggaggcccgccagggccgaggtggccacgcggatcgacgagatccgccgctccagcctcggcgaccggcaggtggccgacagcgccgaaggcgacgagccatctctataaccgccgtagcagtagctcctcccctgatccaccaccacacgtactgtgtcaatctcagtgaatgaaaattgcttagttctttgcatggatcgatattggtcttgcttcacatcagcaacttgggcatgtatgctttttctctttttcttctcttctttatctttttttttgggcctctttctcacgggctttggtgattctattctatagcacatggcactggactcttttattcttg

SEQ ID NO: 82320 - DNA, 118 bp, Zea mays
  Clone ID: LIB3114-015-P1-K1-C12
acccacacgtccgtttgtaacgttaaaccacttttgcaaactattatcacaaaaaaaaaaaatcatttcgtgcttccaaaaaaaaataaaatcaacacaaataaaacaatataaacat

SEQ ID NO: 82321 - DNA, 389 bp, Zea mays
  Clone ID: LIB3114-015-P1-K1-C6
accaaacggaactcctttcaatttgaagatactgcaatgagggattgatgtaacggggcaaattaagatctgctgctggcataacattacgacaatagttcatccgttcgacaacaaattttggcacaacttccacaggttcagcacttgaacaatctaagttaccaacacaaggcattttaagttcatagaaaagtgagaaataaacacatggccatttctagtccatctttacttcaacaaaaccttaaatgctgttcgggtacatgaacactctgaccttgcgccccatggactcaggcgggaggttggacatgaacttggcacggacgacgcccgagtttccgtgcgggcgggtgaactttgctcagatgcacctgtagcggggt

SEQ ID NO: 82322 - DNA, 122 bp, Zea mays
  unsure at all n locations
  Clone ID: LIB3114-015-P1-K1-C7
cctaattcccggggcgacccacccttccctactatttctatatctctntctgcctctctatatgatccaagcttacattctcggggagggcgatatataggtgtgttatagtttcacctaaa

SEQ ID NO: 82323 - DNA, 265 bp, Zea mays
  Clone ID: LIB3114-015-P1-K1-D10
aaaaaaaaaaaaaaaaaaaaaataaaaaatatttaaaaaaaaaaaaaaaaaaaaaaagggggggttaagaaaacaagataaaaaaaacaaaaaaggggccggcccttttataggttcctggcttctatcccctgtcttgctgcctttttcttttcttgttgggccccggaaatccccttcgcttgcccctcttttccaacttcctgcttggtatacccttgcctttccccaattttcccgctgtgctctcattcctcttttttct

SEQ ID NO: 82324 - DNA, 85 bp, Zea mays
  Clone ID: LIB3114-015-P1-K1-D2
aaaaaaaaaaaaacaaaaaaaaaaaaaaaaaataaaaaaaaaaaaaaaaaaaaactacaaaggggggaaaaaaaaaaaaaaaaaa

SEQ ID NO: 82325 - DNA, 97 bp, Zea mays
  Clone ID: LIB3114-015-P1-K1-D4
cggaattccgggtcgcgcacgcgtccgaaaaaaaaaattaacaaaaaataaacctattaaaaaaaaaaaaaaaaaaaaaaaaaaagaagaacggctt

SEQ ID NO: 82326 - DNA, 213 bp, Zea mays
  Clone ID: LIB3114-015-P1-K1-D5
aggtacgtttgaactttgttcgtttgtattgcactattgcttgttgtttaagtagcggttaagggagggagtcgtacgctgtgctaccataatggaagtactccggtccggtccggtcctgtgtgagccttatgtacgtgcaattttaatgtcttttgatattacaagactcgacggttggcaatagatgttgctgttgtgtttcgattgatc

SEQ ID NO: 82327 - DNA, 183 bp, Zea mays
  Clone ID: LIB3114-015-P1-K1-D6
cgcgtccttagtacatttgaactttgttcgtttgcattgtactattgcttgttgtttaagtatctgttaggtgagggagtcttacgctgtgctaccataattgaagtactcctgtcctgtcctgtctctgtgttagccttatgtacaagcaattataatgtcttttaattttacaagactaaa

SEQ ID NO: 82328 - DNA, 421 bp, Zea mays
  Clone ID: LIB3114-015-P1-K1-D8
gagagatccggagcagccgcagtcccaccgaccccgccgccggtcgccctccatctcctcgccgctgcctctcgtttctcttttcaataatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaactttcttacggaccgtccttcaaccaaggtccacgctgctcctggcggtggctcttccctgggctacctgttcgggggcaactgatgcccgtgcttgtgcgctcaccaagt

SEQ ID NO: 82329 - DNA, 342 bp, Zea mays
  Clone ID: LIB3114-015-P1-K1-E1
aaaaaaaaaaaaaaaataaaaatataaataaatataaaaaaaaaaaaaatataaaaaaaagagaaggaaaccataatatataaaaaaataaaacacaattaaaacaataactaataataaataattacacctctaattatattatatcaaaaaaaggggccccccttttttaatccccccttttttcttctccccctccttccccttatttccttttttattcgtcccccatatatccttattcctgccccctttttacacccactttttatcggaaaacccctctgttccccccatttaattttcctttcctatacctccccttttttctccctcctgtct

SEQ ID NO: 82330 - DNA, 248 bp, Zea mays
  unsure at all n locations
  Clone ID: LIB3114-015-P1-K1-E12
taccggtcctnaattcccggggggcgcacncttcctaaaaaaaaaaaaaaaaaaaaaaaacaatataaaaaaaaaaaacggctgcctctctatggtggccaaacttactagcgggggcgggcaactataataactcttcttatattttcatcctaaatccaattcacttgccgtcttttttacaacattcgggatttgaaaaccccttgcttttcccattttaaaccccttcctgcacatcccccttt

SEQ ID NO: 82331 - DNA, 271 bp, Zea mays
  Clone ID: LIB3114-015-P1-K1-E9
cccacgcgtccgactagttctagatcaagcacgcgctgactctcttcaccgactttggggcggttcttgttcgaatccttgtcatcatgatgaagaatgcacaggagaaatcccaagacgagaagaagaggaagaagcggtagctgctgaatgaattggatgacatatgttgttgtggtcactacttcatagtaccgtgtactcctatcctattgtactaataataataatagtaagacgaaagatgactgctgggaatgaatatttggtt

SEQ ID NO: 82332 - DNA, 371 bp, Zea mays
  Clone ID: LIB3114-015-P1-K1-F1
tttctctttcgacgccactcatatctaaaaaaaaaaaaatattaattaaaataaaaaatatatatttaaaaattaataaatttaaataatgtgggtataataaaaagaattaaattaaataattttattttttttataatttttaatatattttttatattttattattatttttgtttcttcttcttttataataaaaattattttaatctatttattatttaaaattttttataatttattttatttttaaaaattatttattctttctttaaatttaaaatattctatttgataattatttaatactttttcactatttttaattttataaaaattatatattaaattattaaatatttttattttta

SEQ ID NO: 82333 - DNA, 334 bp, Zea mays
  Clone ID: LIB3114-015-P1-K1-F11
gtaccggtccggaattcccggggggagccacgcgtccgctcgtcatagatggagatgttagcaatagtgattggaatgccatccttgccgcatgaccgtgaaagaacaacggtggtaggattgtccgtatcatgcaaggtatacataagcagccacgtggtattgctgcaaaacactggattgagctgaaatgttttgaaacagaaaaaaccactagcctattcatccaaagggtgtgctgatggaaaaaaaaaccatatataagaaatatttaaaaaaataaataaattgggggtgtattatatagtgtatattggttattaatgagtgaatt

SEQ ID NO: 82334 - DNA, 388 bp, Zea mays
  Clone ID: LIB3114-015-P1-K1-F2
tccggtccggaattcccggctcgacgccacgcgtccgcggacgcgtgggttcaattcaaaaaaaaaaaaaaaaaaaaaaaaaaaaaaaaaaaaaaaaagaagataaaaaaataaagaaaaaaaaaaaaaaaaataaaaaataaaaaaaaaaaaaaaaataaaattaattaaaaaaaaaaaaaaaaaaagtggggcgccctttttttagatcccacttttcttcccccctccttctctctttattattttttttttttggccccattttctattttccttgccggtttttttacaagttttagctctttgtatattcccttttttcctacttattttctctccttttattatttctttttctttcttccctttttgctacttttttttt

SEQ ID NO: 82335 - DNA, 156 bp, Zea mays
  Clone ID: LIB3114-015-P1-K1-F3
catagaacagtgtgcgataccgatgggagcttgtattgagaagtagctcatctgtttttggtgttttttttttttgtgtgtgcatatgtgtataatgtatccccctcctgggctcttgctgataatgatatgtatgtactgtatgtgtttctcgcg

SEQ ID NO: 82336 - DNA, 196 bp, Zea mays
  Clone ID: LIB3114-015-P1-K1-F4
ggaaaaaaaaaaaacaaaaaaaaaaaatttcaaatataataaaaaaaaaaaaaataacctgggtagcctactttaaaaagggggccctcctactctattaatttttttcattttttacttatatatatcgggggcgtccctctttttgaaactcgcgtgtctttccttcccactccttttacccaccttttttttt

SEQ ID NO: 82337 - DNA, 115 bp, Zea mays
  Clone ID: LIB3114-015-P1-K1-F6
cggtcggaattctgggtcgcgcacgcgtccggtcaccaggatgtggtttatatatgacattatttatgctaaaaaaaaaaaaaaaaaaagggagaggaaaataacaggggggggg

SEQ ID NO: 82338 - DNA, 55 bp, Zea mays
  Clone ID: LIB3114-015-P1-K1-F8
aaaaaaaaaaaaaaaaaaaaaaaaaaaaaatataaataaaaaaaaaaaaaaataa

SEQ ID NO: 82339 - DNA, 249 bp, Zea mays
  unsure at all n locations
  Clone ID: LIB3114-015-P1-K1-G12
gtccggtgctaattccggggggcggacacgtccgagcccgcggtgggcgatcctgccgctgatgagtccgagaaggcgcnanctctcccgtttagtatgggctataaggcgcggggggtgactccttgctccttgctctcactgctgcggcggacagcgggtctggagatctatgggtcatcgcgcgcgcgcctacatgggacgggcttgctgttcagtacaactcgaacgtgacggtgtctttccatt

SEQ ID NO: 82340 - DNA, 115 bp, Zea mays
  Clone ID: LIB3114-015-P1-K1-G2
cgcgtccgaaaaaaaaaaaaaaaaaaaaaaaaacaataaaaaaaaataaaaaactaacatacacaaaacatggagggtaataaaaagggggatagggccacctaaattcaattca

SEQ ID NO: 82341 - DNA, 161 bp, Zea mays
  unsure at all n locations
  Clone ID: LIB3114-015-P1-K1-G4
gtccggtccggaattcccnggtcgaggcaggcgtccggttttcgctccttctccctccctcagtagccgccgccgccccgccgccgcctggtgtaggtagaactgtgtacggagtcgagttggtttgccagctgtttcaaggttacagagttgagatttgg

SEQ ID NO: 82342 - DNA, 390 bp, Zea mays
  Clone ID: LIB3114-015-P1-K1-G5
cggtccggaattcccgggtcgagcgacgcgtccgctccacccactcgatggccgcgggcgtgctgcaggcgatgctcgggccccacggcaccgtgtgcgctcgccgagtcctgagggaagagcctctcgaatatcatccggtagtagtaggcctccttgttgacgggcgtgttgtaggggaacatctgggcggcgttgttcatcatctcatccgtcacctgctgttcagtgaaggatttgaggccatcgatccagttgtagccaacgccgtcactgaactggtctttctgcctgtagagaatatgctgcggatggtaaaggtgtcagttttcagggcttgcaatgcaaacttaacacacgggggtaattaaattaaaccaggcttctctg

SEQ ID NO: 82343 - DNA, 202 bp, Zea mays
  Clone ID: LIB3114-015-P1-K1-G7
taccggtccgaaattcctggggcgacccacacgtccgcatgttgaatgcttgacgagaaacattcttgtgtgtagttaacaggtcaccctgttgttgttgttgtagacattcaagcagacattttgttttcttctaaaaaaaaaaaaaaaaatacaacaaataaaaaataaaaaacaaaaaaaaaaccacaataaaattatc

SEQ ID NO: 82344 - DNA, 129 bp, Zea mays
  unsure at all n locations
  Clone ID: LIB3114-015-P1-K1-G9
taattcccggggggacgcacacatcctgactatttctatatcgcnagcggcctctttanaggatccaagcttacttacacatgcagtcggacgtcatagctgtggtatactctcacctaaatttaattt

SEQ ID NO: 82345 - DNA, 151 bp, Zea mays
  Clone ID: LIB3114-015-P1-K1-H1
agttcatgtcgcatgcaaagaaattattacgttggaaaaacagaacaaacttcttgagggagaggagaaagaaaagcgtgaagaacaagagcgcaggttgaagaggagaacaagagagagagaaaagaagaacaggagaaaagattgcttg

SEQ ID NO: 82346 - DNA, 346 bp, Zea mays
  Clone ID: LIB3114-015-P1-K1-H10
ccccccccccttttttttttttttttttttttttttttttttttttttttttttgggtgggcaacacaaaggggggggtttggataaaatcttaaatggatggggacccaccacaccggggctcatgggttgcctgttatgggggggcacccaaaaaacacatctcactgtttttcaaaaacccccctgggggcccgggggggacacgaccccctcatatgctcatataattattttaaattcagagattccctgggcacccacttgattggatgacttgaaacacacccagtgccgctcgtttactttattaagctttataatttagttgggttcctccggccgg

SEQ ID NO: 82347 - DNA, 78 bp, Zea mays
  Clone ID: LIB3114-015-P1-K1-H12
tccgaattcccgggggagccacgcgtacgggacgccgaggaagacgaggaaaagaactccgagcccttgccaccgcct

SEQ ID NO: 82348 - DNA, 377 bp, Zea mays
  Clone ID: LIB3114-015-P1-K1-H3
taagttcaagggatgcaccgggatgcccaacattggatatggctccgacaagaagaccaggcactaccttcccaacaagttcaaaaagtttgttgttcacaatgtctccgagctggagctgctgctgatgcacaacaggacttactgcgctgagatcgcccacaacgtgtccacccgcaagcgcaaggagattgtggagcgtgctgcgcaactggacatcgtggtcaccaacaaggttcgcaggcttcgcagcctaaaggacgagtgaaatgttgagtagttttgattgggcttctgttgtgggtgaaaatgttacctgaaattgatgttcttctggacccatttctaatgcttatgatagaccttacatatcggcc

SEQ ID NO: 82349 - DNA, 69 bp, Zea mays
  Clone ID: LIB3114-015-P1-K1-H4
cccacgcgtccgaaaaaaaaaaaaaaaaaaaaatatatttaaaaaaaaaaaaaaaatacagagaagaag

SEQ ID NO: 82350 - DNA, 57 bp, Zea mays
  Clone ID: LIB3114-015-P1-K1-H5
aaaaaaaaaataaaaaaaaaaaaattaaaaaaaaaaaaaaataaaaaaaggggggat

SEQ ID NO: 82351 - DNA, 78 bp, Zea mays
  Clone ID: LIB3114-015-P1-K1-H7
attcccggggggacccacgcatccgagattatattatggacaacacttaatcaattttataaattgactggaccaaaa

SEQ ID NO: 82352 - DNA, 55 bp, Zea mays
  Clone ID: LIB3114-015-P1-K1-H8
cctgcagtaccggtccttaattcccgggggcggcccacgcgtcccggaatgatgc

SEQ ID NO: 82353 - DNA, 298 bp, Zea mays
  Clone ID: LIB3114-017-P1-K1-A1
acgcgtcctcactccactcctttataaataactagtgttgcctcggacctggggaagagtgcgaattccacgtagctcagttttcgtgcgttggacaagatagatgtaaagttttcgcgataatatcgttctctcttacaaagaaaggggttttactactgccatttaaaaaaaataaaaaaatctactttataataacaaaaaaaccacaaaatttaataaaactaataattatacaaaaaaaaaaacggccggcctttctagagaatccaagctttcctacgctttcattcaactt

SEQ ID NO: 82354 - DNA, 582 bp, Zea mays
  unsure at all n locations
  Clone ID: LIB3114-017-P1-K1-A7
cccacgcgtccgaaataaaaaaaaaataatataaaacaaaaaaaaaaaaaaaaaaaaaaaaaaaggggttnttttttttaaaggggaaaaatataaaaaataaaaaaatttaaaaaaaaataaattaaaaataataaaatatttttataaataaaaaataattttggggcgcccttttttatttttcaaattttctttccccttccttcccacttaattctttttttttttttcccctaaattaaatttcattgcccgctttttaaaaacttcgcacttggaaaaccccttctttccccaattttatttcttttgaaaaaattcccttttttccactttgtttttttacaaaaaaacccccccccttttttcttttccaacaattttccccccttattttgtaattggccccccccctttcccgtttttttaatcccgctgtttttttttttttcccccacgtttcccttttctttttcttacccctttccccccttttttttgttttttttccttcctttttttccccctttccccgttttctcctttaaagttttaatttggggccccctttttggttcc

SEQ ID NO: 82355 - DNA, 618 bp, Zea mays
  Clone ID: LIB3114-017-P1-K1-A8
gtaccggtccttattccctggtcgacccactcgtcctcccactcgtccttataaaaaaaaaataaaaaaaaaaaattataaaaaataaaaaaaaataaaaagtggaaatttttataaaaaataaaatataattaattttatatttacatacttataaaaaattaattaattttttttaataattacattattaatttttgtcccccttttttaaaataccaatttttttttccccctatatcacattatattttttttttttttttccctttaaattattttaatctccttttttttaaaaattaatctcttttaaaaaccttatttttttcctatttttttttttttaataaattccttttttttatatttttttttaaaaatatattccccttttatttttttttttttcccacctttttttaccctttattttttttttttccttctctctttttctcttcatttttaaactcttactttttttttttttttttttccaatatgtttcctttttctttttttttaatttttttttttccccattttttttcctttttttttccctttttttttttttaaaaatatttttttctcttttatttcttatttaatttt

SEQ ID NO: 82356 - DNA, 95 bp, Zea mays
  Clone ID: LIB3114-017-P1-K1-B11
aaaaaaaaaaaaaaaaatatatataaaaaaaaaaaaaaaaaaaaaaaaaaaaaaaaaaaaaaaagaggggaaaaaaaaaaaaaaaaaaaaaaaaa

SEQ ID NO: 82357 - DNA, 249 bp, Zea mays
  unsure at all n locations
  Clone ID: LIB3114-017-P1-K1-B2
acatacacctccccaaaatccctttctcggcacacgcgccaaaaataattntaaaataaaaaacaaaaaaattaaaaatataaaaaaataaaaaaataaaaaattgcggcgccttttaaaaaatccaaccttacttacaacttacttccaacttactattttttttatattttcacctaaattaaattcactacaactaatttttacaacttcttaactctaaaaactttgccattaccaaacttaatc

SEQ ID NO: 82358 - DNA, 183 bp, Zea mays
  Clone ID: LIB3114-017-P1-K1-B4
ctgcagtaccgttcctgaattccctggtcggcccacgcgtccgcccactcgtcctaaaaaaaaaaaaaataaaaaaaaaaaaaaaaaaaaaaaaaaaaaaaaacaatgtgaaaaaatccaaactgacgtacgcatccataacaacgtcactacctcttttataccgacacactaaatccaatt

SEQ ID NO: 82359 - DNA, 267 bp, Zea mays
  Clone ID: LIB3114-017-P1-K1-B9
aaataaatatatatcgagagcggcctctataagatgatacaattacacacacaacacatacggagaggatatatctcatatagagagacataaatatggccgccctctccacagatttaaaacttccttgcgtctgaaaacaccgtcattacacatattaatctccccctaaaacaaatccctttgcccagctttaaaaaatatacgaaaaggggaaaacccatcgctctcccaaccaaatgcgcatactgaatatcccatttgacc

SEQ ID NO: 82360 - DNA, 113 bp, Zea mays
  unsure at all n locations
  Clone ID: LIB3114-017-P1-K1-C10
cacctgcagtacctntccatattccctgtcgggggagcgtccgcaaaaaaaaatctaaataaaattataaaaaaaaaaatataaaaaataaaaaaaaaaataaaagggggggg

SEQ ID NO: 82361 - DNA, 298 bp, Zea mays
  Clone ID: LIB3114-017-P1-K1-C12
tacgcctgcggtaccgttccctaattcccggtcgggcacgcgtccgggtctgttattcgtttacatttacctatccaaatacttagctaatatagtactgtatgctggggctatctactgccatggatccagatataaaagtgctatcgtattctgtatttccaaattatttacatgtcccacatgcaacttcacgtctatgtatctgaatcccgaacatcttctcaacccgtcgctaaaccacctctttactccataaacacctttctttccaaacttaattggcctgtaaactatt

SEQ ID NO: 82362 - DNA, 92 bp, Zea mays
  Clone ID: LIB3114-017-P1-K1-C2
ttctagatcttgagcgggcgttctagagattcaagcttcttacgcttgcatgcgagtggatacctctcctatggtggcacctaaattaaatt

SEQ ID NO: 82363 - DNA, 63 bp, Zea mays
  Clone ID: LIB3114-017-P1-K1-C3
cacataacaaaattttattataatcaaataacattaatttaaaaaaaacaatacttattaaaa

SEQ ID NO: 82364 - DNA, 259 bp, Zea mays
  Clone ID: LIB3114-017-P1-K1-C7
aaaaaaaaaaaaaaataaaaaaaaaatataaaaaaaaaataaataccgcacaaataaaataaggcggagattacatacactgtgatgcgacctaaaatcactccactagccatccctaaacaaaatccactctccgaaaacctacaccttactcaatttaacccccctgccgtacacccccctattccccgctggcaaaatcccccatttgccagctcccttcatccttaccaacacttgcccattctgactttccaac

SEQ ID NO: 82365 - DNA, 60 bp, Zea mays
  Clone ID: LIB3114-017-P1-K1-C8
tttcctcaattttaattgctaatgccaccccccctgtatcgtcacattaaactcgctctt

SEQ ID NO: 82366 - DNA, 579 bp, Zea mays
  Clone ID: LIB3114-017-P1-K1-C9
gtacgcctgcagtaccgtccgcatttcctgtcgagcgaggcgtccgagcacaacgaattttgagttccacaaggaacatttctgaattccagtaatacttggtgcgcacaaatgatatattatgtgtgtgtacagcatttttgtcttggtatgttcatctggagttatggacgaacatgagagcaaagtggagaagctaccatcaaatgcttaacagctgacggcctgcactctttgttaactgctcctaaatgaaccagaccaccaagaagtgggatttttgtgtacatatacatgtgatgtccaaacgtccatctgcagattggacccctcaactgtgaagagattcctaccaggtggtcaccaatgtacagagcacacatgaagataaagagtagtttggattgtcggtagcatgctattcgtataggacaggagggataccactagtcacaacacacaaggctatttaattgtatattttcatgcagttgatgccctgcactttctgctgctggccaatgcggcaaggacagaagcattttttctcatttgtaccggattcagaaaaggcattac

SEQ ID NO: 82367 - DNA, 534 bp, Zea mays
  Clone ID: LIB3114-017-P1-K1-D1
gcacaacgaaatttgagttccacaaggaacatttctgaattccagtaatacttggtgcgcacgaatgatatattatgtgtgtgtacagcatttttgtcttggtatgttcatctggagttctggacgaacatgagagcaaagtggagaagctaccatcaaatgcttaacagctgacggcctgcactctttgttaactgctcctaaatgaaccagaccaccaagaagtgggatttttgtgtacatatacatgtgatgtccaaacgtccatctgcagattggacccctcaactgtgaagagattcctcccaggtggtcaccaatgtacagagcacacatgaagataaagagtagttgggattgtcggtagcatgctattcgtataggacaggagggataccactagtcacaacacacaaggctatttaattgtatattttcatgcagctgatgccctgcactttctgctgctggccaatgcggcaaggacagaagcattttttctcatttgtaccgcatacagaaaaggcataacaa

SEQ ID NO: 82368 - DNA, 283 bp, Zea mays
  Clone ID: LIB3114-017-P1-K1-D12
gcctgcggtaccgggccggggtattcccgggtcggcccacgcgtccgcgatctatcactctgtcaagcgagctcatatcacctgatgtcagtgtgctgtaccgtgctatactcgaccgagaaacctaagcgctcataaaacttgttctacaattcaggtgcatcgaactactttatggttttgctagagttcattctggttataattgtagaggaacgaaacgatgagagaacactgacttttccgtttctctgcattcatgtaatatgatctcggaagcgat

SEQ ID NO: 82369 - DNA, 517 bp, Zea mays
  Clone ID: LIB3114-017-P1-K1-D3
aaataaaaataaaataaaaaaataaacaaataaaaaaaaaaacaaaattacaaaaaaaataaataagagaaaaataaataaaaataaagtggcacctaatttaaaactctcctaccttactttctctaacttcccaccccttatttcttttttattgtcctttatatttctttccttgtccatccttttttaccgtctttccttataaaacctttttctccccctttttaatctctttccatttatatccccctttcctttccctatcttactcccctttattcccccccctatttcccttcccaaccgtttctccacccaattcccccttttcactctccctttcactttccctcatttcctttcctattttttccttcccttctagcgttaccttttacactttcccgctcccttttttcccctcttttcccccttttcctttcttttttctcaatttcctgttcctttcccttccaccctttaattctagacctttcttccagctttccctttt

SEQ ID NO: 82370 - DNA, 259 bp, Zea mays
  Clone ID: LIB3114-017-P1-K1-D5
acctttccttaattcccggatcgacgcacgcgtccgaattaaacaaaaaaaaaaaaaaaaatcccaacaaaaaaaaaaaaaaaaaaaaaaaaaaaaaaaaagggaaaaaaaaaaaaagagagaaaaaaaaaaaaaaaaaaaaaaaaaaaaaaaaaaaaaaaaaaaaaaaaaaaagggccgccctttttaaaaaatccaagtttacctccccttccttccaacctaataatttttttatagggccccctaaattaaatta

SEQ ID NO: 82371 - DNA, 182 bp, Zea mays
  Clone ID: LIB3114-017-P1-K1-D6
aaaaaaaaaaaaaaaaaaaaaaaaaaacaataaaaaaaaaaaaaaaaaaaaaaaaaaaaaaaaaacgggggaaaaaaataaaaaaagaaaaaaaaaaaggggcggcccctttaaaggacccagggctacgtccccgggcgtgcaaacccttacctttcttatcttggcccctaaattcaatt

SEQ ID NO: 82372 - DNA, 207 bp, Zea mays
  Clone ID: LIB3114-017-P1-K1-D9
aaataaaaataaaatattaaactaccaaaataaaaaaatccaaacctctctacacaatcatagcgtagttattcatacgggctacagcaatacttaattttattttatcacctaaaatttaaataacttcccgtctttttacaccttctttattctgaaatcccttcccttacttaacatcccttttttgccacacatccccctttc

SEQ ID NO: 82373 - DNA, 568 bp, Zea mays
  Clone ID: LIB3114-017-P1-K1-E1
cctgcggtaccgttccggaattcccggttcgagcgaggcgtccaagcattaggatgtacattaacaaaatactgctacccggttatatgtccacgatcatcgtcggtggggctgtctggctatctgtgtgtctgtccaagtaacagcagggtttaagggtaggtgaaacttgagcggcccttccctgcattcgccggacgcgccgagcgtccgcgggcagcgagaagcggcgaccaagtgcaagattcttttgtttgattcgtatcctttgtttttgttgtaacttctcaagtttttccgttctgcctggccaagtactagcgtcctgctcttctcccaagattgggttgcattgcatgtaaaaaaaatgtaacgccggagcagcgactctttgtgggctggcgaacaggtgtggtatgcctacaatacaaaggctagcaagcagaactggctgggtaaacacacagctctgctttcttcttcttcgacattttcgcaagttttttttgtgtgtgtgtcctgtaaacatcaaggtctcaataaagaaagggaaccgctttttttgtgt

SEQ ID NO: 82374 - DNA, 75 bp, Zea mays
  Clone ID: LIB3114-017-P1-K1-E6
ttttaaaggatccaagcttacttacccttgcatccaacataataactcttttataggggaaccaaaattaaatta

SEQ ID NO: 82375 - DNA, 66 bp, Zea mays
  Clone ID: LIB3114-017-P1-K1-E8
attcccctctcgacccactcatcctaaaaaacactattttttatatacaatcctctttaataacct

SEQ ID NO: 82376 - DNA, 68 bp, Zea mays
  Clone ID: LIB3114-017-P1-K1-F1
acactttattaaatttatatatttaacaaacttaaaaaaaaaaaaaaaaaaaaaaatggggggttttt

SEQ ID NO: 82377 - DNA, 77 bp, Zea mays
  unsure at all n locations
  Clone ID: LIB3114-017-P1-K1-F11
tacctntcctttattccctgttcgacccacgcctcctaaaaaaaaataaatataaaaattcaataaaaaaacattta

SEQ ID NO: 82378 - DNA, 152 bp, Zea mays
  Clone ID: LIB3114-017-P1-K1-F12
gtcagttggtgcggtgtgtccgcttaaactttatttgtggttggttggtacttttgtggtgggtatttttttggacctcgtgatagtcggtcggttcaatgttatcgcggctactggcaaaccttaagtgatacggtattcttctttaaaaa

SEQ ID NO: 82379 - DNA, 318 bp, Zea mays
  Clone ID: LIB3114-017-P1-K1-F2
tcccgtgtcggcccacgcgtccgcccactcgtccgaaaaaaaaaaaataaaaaaaaaaaaaaaaaaaaaaaaaaaaaaatttaaaatgagggaaattataacaagtgataaacgcaaaaaaaaaaaggctttttaaaactatattttaccccttatcctacccaaaaacctggaacaatttatttttccctaatcacaaaacccttcccataaaccctccatttaccaaatctactagatcaagtatcccacaatttcttcacagaaaaaaccctattttttctttaaaagactacccccatcttccttatcctcttt

SEQ ID NO: 82380 - DNA, 324 bp, Zea mays
  Clone ID: LIB3114-017-P1-K1-F4
ttaaaaaaaaaaaaatccttccatttattgatccaattatacgggggggtcctcaaagggtacgtctctataaatcacctaaatcaatccattatcattctataacacttttactcctaaaatcttaatccccacttaattccccccaaacatcccccttttccccttcttttaataatatccctaccaccttcttccaacatttttcatcttaattccaatttaacactccctttactctcattaatccccatctttttcttaccctcacttttccatactctttcaccccctatctcccttcctttcatttcttccttcttt

SEQ ID NO: 82381 - DNA, 350 bp, Zea mays
  Clone ID: LIB3114-017-P1-K1-F9
aaaaaaaaaaatataataatattaaaataataaaaaaaataaaaaaaaaaaaaaaaaaaaaaaaaagaggatttaaaaacaaaacgatggcactttaaaaactcctataaaaaaaacaataaaaaaatatcaatattaaaaaatattttccccccctttttattatattcccatactaactttctcccccctctaaaccccctaccttttccccttctttctccaccataatcacaaatcctccctctcccttttttcccctttttacctagataaccttaccccttctccccttcctaacaattttctcaatcaacaaccctctttccccacccttccttttatactca

SEQ ID NO: 82382 - DNA, 344 bp, Zea mays
  Clone ID: LIB3114-017-P1-K1-G1
caatctaacctacccttcccttccatgcgagagcttttctattgggtggcgtgacttaaattcaattcactgcccttcataacacaatgtcttgactaacaataccctgacctaacctaatttactcgccttacattacatcctcattaccccagctaacatccaaacgaacaggaccgaaccgatctcccattccctacagcagcccaaattgatatatggaacgcgccccgccctgtagcattacattaagcgcgggtggtgtttacgctcagcgcaacctgaacacttgacttggcattaacttacggtcctttccttttcttttcttcctttcctttctc

SEQ ID NO: 82383 - DNA, 235 bp, Zea mays
  unsure at all n locations
  Clone ID: LIB3114-017-P1-K1-G10
acacctgcagtactcttccttaattcccggatcggcccacgcgtccgatctaagcttncacatggagagtatgatccagatgattacctgtaaaaagcttatggatggggggcactctctcaagatgtgtgggtcttctattacagtctctgatcatggttatattcattactcaattcacaccacctatactcattcgaagtgggtcccctccaattacttccccctttattca

SEQ ID NO: 82384 - DNA, 98 bp, Zea mays
  Clone ID: LIB3114-017-P1-K1-G11
tttacacctacaataccgttcctatattcccctttcgacccacgcgatcccggactcgttgtaaaataatttacatatataatattctttctatataa

SEQ ID NO: 82385 - DNA, 232 bp, Zea mays
  Clone ID: LIB3114-017-P1-K1-G12
agcgaccactactatcctagagcaaattgattatcgtcaaaaaggagaaaaaaaaaaaaaaggaggaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggatcaaagcttacgtccccgtccatgcgaaagaaaagtttttttatagggtaaccaaaaataaatt

SEQ ID NO: 82386 - DNA, 209 bp, Zea mays
  unsure at all n locations
  Clone ID: LIB3114-017-P1-K1-G3
cgggggacgcgtcctcnnactctccaagctgaataaggcgtccacggcttaagtcccttttggtggatggcaatgttagggggggggtttcatgtagcatgagggttttgtatttgagtgttgtcaaagccagaattagtaatatgtggcatgtgtacccttttaaaactagataaacaatgggtgtactctgcatattttggcgggaa

SEQ ID NO: 82387 - DNA, 112 bp, Zea mays
  unsure at all n locations
  Clone ID: LIB3114-017-P1-K1-G7
tttacacctgcagtacctntccttaactcccacctcggcccacccctcccacataatactctatctataatataaaataacaatctactttaaaaaacctcctcaaaataaa

SEQ ID NO: 82388 - DNA, 72 bp, Zea mays
  Clone ID: LIB3114-017-P1-K1-H12
taccggtccttaattcccgtgtcgacccactcgtccgaataattctaaaaactaaaacaatcaatctaaaaa

SEQ ID NO: 82389 - DNA, 481 bp, Zea mays
  Clone ID: LIB3114-017-P1-K1-H4
tttcctgaattcccgggtcgagcgcgcgcgtccgaaggaagcgccttggtaatggaatgagtgtacaagggaatgtggatccagcatttctgttctgggggttaccagtactgactgatgaaattcgtaggaccttcgtacaggggaagtgattgggactggccgttactgtagagctgctcctcgactgtacatctcggacactttgcggcttcccttcttggctacgtctatagcgcatgtgctttcagggttgtgaaagcacctggtacaaaaggtcatatacttaacttgggccacggtgtactttagaaaacacccgaagaagctgtatcacatttctttgatgtaacaaggatgcttgagatatgacacccattttcaaggttctgttgctgaaggattgcaccctgttgcttgattagtagcgtcgtctgcattctacctttttaagacattactcattattgaaccctggata

SEQ ID NO: 82390 - DNA, 127 bp, Zea mays
  Clone ID: LIB3114-017-P1-K1-H6
cctaattccccgccgcgcgcgcgtccaaaaaaacataaccaaaatatgtatacgtataaatgttccaaacttacttactcgtgcatgcgaggtgataactcttctatagtggcacctaaattcaatt

SEQ ID NO: 82391 - DNA, 322 bp, Zea mays
  Clone ID: LIB3114-017-P1-K1-H8
gactagttcttgatcccttaatcaaaaaaaaaaaaatttaaaaattccaattttaataaataaaggggatctctcaccaaagagcacagccttatataaaaacatttctcatattaaataaaaaaatcaaaaatatgcgggctccccctttaaaagttaaaaattcccaacccctttcttccccccctatatctcttttaatagccccactaaattaaattcttttcccttttttttccaatttttcacctaaaaaaatctatgttttccccaacttaattattttttaaaatatcccccttttgcaacttgtctttacatc

SEQ ID NO: 82392 - DNA, 126 bp, Zea mays
  Clone ID: LIB3114-018-P1-K1-A1
cgcgtacgtgtaaagtttcggttaacagattgatgatggtcttgattatagcgcgcgaatgtgtgctcgaggtaggtttggacatggttattattggatccatgtcattataatcctctaagtttt

SEQ ID NO: 82393 - DNA, 177 bp, Zea mays
  Clone ID: LIB3114-018-P1-K1-A11
taaataaataatatatataataaaaaatatatttaatatattaaaaataaaaaaaataaacaaacgaggtatttttaaaaaatgggccggcctctcttttttttcttacttttctttttctttctcttcccttccttttcattttctctttttttcccctcacttattttctttccc

SEQ ID NO: 82394 - DNA, 86 bp, Zea mays
  Clone ID: LIB3114-018-P1-K1-A8
tctagaggattcaagcttacggacgcgtgcatgcgagcggatagcttttgtggggggggacctaaattcaatttactggcccgtgg

SEQ ID NO: 82395 - DNA, 156 bp, Zea mays
  Clone ID: LIB3114-018-P1-K1-B12
aaaaaaaaaaaaaaaaaaaaaaaaaacaccaccaataaaacaaatccaacatacatataaaaacccgagaccataataaaaggcgcgcccgtctcttttttcaacaacttttttatctcttacttctctcctccctttccctttttttcctcctct

SEQ ID NO: 82396 - DNA, 74 bp, Zea mays
  unsure at all n locations
  Clone ID: LIB3114-018-P1-K1-B3
tctagaggatccaatcttacgtacgcttncatgcggggtggtatctctctgtataggggcacctaaattcaatt

SEQ ID NO: 82397 - DNA, 62 bp, Zea mays
  Clone ID: LIB3114-018-P1-K1-B8
attcccgcgtcgacccactcttacctaaaaaaaaaaaataatataaaatcaaaactctccaa

SEQ ID NO: 82398 - DNA, 74 bp, Zea mays
  Clone ID: LIB3114-018-P1-K1-B9
ttctaaaggatccaagcttacttacccgtgcatgcaacgtcatagttcttctatagggccacctaaattaaatt

SEQ ID NO: 82399 - DNA, 247 bp, Zea mays
  unsure at all n locations
  Clone ID: LIB3114-018-P1-K1-C3
ccctcantaccntcctaattcccagtcgaccccgcgtcctnannttttctgttttttatgatactntaatttncttcnccatcggggcctcccatcatatgcggcggccatattttggcgagctccctcccccacccttccccttactcaaatctgcaccctctaccatccacactcctcccgctctattcggcaaacccccctcccttatctctccctatccaacacaaaaccgaacaaataacct

SEQ ID NO: 82400 - DNA, 291 bp, Zea mays
  Clone ID: LIB3114-018-P1-K1-D12
taaataaaaataaatataaaaaaaaaaaaaatataaaaatataaaattacaaaaacaaaaaatgcgtggtaataaaaaatgggatggagttattttaaatttaattcataattcttttcttttattctctttttaattttcttttctctttttttattccttcttttctttttttttactcattacatttttttttattttttcttttttcattatcttttcttcttttaatatatcttatttattctccctcatttcttatttaccgaatttttctttattttccctttt

SEQ ID NO: 82401 - DNA, 396 bp, Zea mays
  Clone ID: LIB3114-018-P1-K1-E10
ctacaacgtgttgattgaggagctgcctgccaatgttgctgaccttctgtgatcaatttcaagaaaaaacaaaacaaaaaagggtggtgaggaacctggtaaggcttggttttgtcgaaataccgtgggagagggggtgataaggacggtggggtttctatgttgaagtcgtggtcatggacaatttgtgattttttctcctttatgccatgttttggaatttttgtagctgcctaggccttgtggtaatgtgctgctgtgggggttcattagtatgaagaggaagacgctgctggcgctgagtctttctctttattagtattttgtttaaaactatgtatgaccgaatggtggtatttatttgtgtcatccttgactcttattctgctgcaaaaa

SEQ ID NO: 82402 - DNA, 85 bp, Zea mays
  Clone ID: LIB3114-018-P1-K1-F1
agataacgatcggtggctgatgtgtaagtgtaagtttattgaataagctgagtcacagcatacgagaattctcatgtgggacact

SEQ ID NO: 82403 - DNA, 297 bp, Zea mays
  Clone ID: LIB3114-018-P1-K1-F10
aaagcacgtacggccgcgtgcctggtctagctacgcggccggttgatcttgagcagttaagcgtgtacgaaacgacagcgctgtgtacgtgtactgtctgctgaagtgtgagatgtactgtctgtgtgtatttggtatggatccgatcggcctgatgtatgaaaaggatgtttacgtactatataaagatggaaaatcgtaaaaaaaaaaaaaaaaaaaaaaaaaaaaaaataagggagataaatatagaagaaaacaaaatatctataggcatataaacataatgtataagttttt

SEQ ID NO: 82404 - DNA, 326 bp, Zea mays
  unsure at all n locations
  Clone ID: LIB3114-018-P1-K1-F11
tttacacctacagtaccnntcctnaattcccgcgtcgacccacacgtacnacttatatactatataagaaacaatccatttcccaacataaaaaaaaaaaaataaccggcccggctataaaaaaaacaggtccacaataatatctatcttacaaatcaacacacctaatattcaaatataattaacggcccccctttctaaaaaatccaacttaaccacctcctcctttcaccttaatatctttttctttatcccaaccaaaattaaatcaactcccccctttttaacaacctctaacctgtaaaaaccctttctttccccaactt

SEQ ID NO: 82405 - DNA, 411 bp, Zea mays
  Clone ID: LIB3114-018-P1-K1-F12
cttcctttacctcgctaggaagctggcaggggatcagaaccttcactttgttgaagctgttggtctgaagccaccagaagtgcagattgatatggccctgcagcagcagcatgaagctgagcttgcagctgccgctgcgcagcccctccccgatgacgatgatgacctgatcgaatagatatgttatacatggcccttgttgatgactcttgttaaaaatctgtggtggttcaatccttgttagtgttaggcggtacctgaatgttctcttgatgtatccgaagagttgagaaggaagttaatgactcagtatcctgttggcttgttgacttggttttttggggaacctgtccttgagggaatacagaggtattgtcaggcagtacgcttcagtgcttgattgttcctttc

SEQ ID NO: 82406 - DNA, 367 bp, Zea mays
  Clone ID: LIB3114-018-P1-K1-F3
tatctgttgtatgtatcttggtcagatgaactctattattgtgccatatatctcgcttgattggacagagtcctttcgagagtgggctcttgtccttgcttaccgatggcagggttagaaggagagagttctaaaaaaaataataaaaaaaacaatgtataaaataataaaaaaaacataaaaaaattcaaaataaaacttaataatataataaaaaggggcggcctctctaaaggatccaatctaacttacccttccatgcaatgtaatacttctttttataggtgacccataaataaatacactggccgtgtttttacaacgtgtagattggaaaaaccttggcgcaccccaactaaatcccctt

SEQ ID NO: 82407 - DNA, 285 bp, Zea mays
  Clone ID: LIB3114-018-P1-K1-F6
aaaaaaaaaaaattaaaaaaaaaaaaaaaaaaaaattaataaaaaaaaaaaaaaaaaaaatgggcgggtaatttggcggcccgtctttagttccatcttacttacccttccatccaatttattactctttctataatttcaccaaatatcaatttactccccctttttttacaacctcttcactggaaaaaccctttctttccccatcttaattctcttcatctacatacctttttctcctactgacttattatcaaaaagtcccttaccaatcccccttcccaa

SEQ ID NO: 82408 - DNA, 254 bp, Zea mays
  unsure at all n locations
  Clone ID: LIB3114-018-P1-K1-F7
acacctgcaggtaccnntccnnaattcccggggggacccacgcgtccggtttcccaacaacagcaaccccaaaacaaaacaaaaaaaagtgtcatggtgagagatcggaggggtgcctgttgggggggcatcctgtagttcatatgtgtccatagctgtcggaaaaattagtataacttcatcctgtggttcataattgtacgcaaaagaattactatcatgattgcctgaaatataacttcaccctgttacag

SEQ ID NO: 82409 - DNA, 88 bp, Zea mays
  Clone ID: LIB3114-018-P1-K1-F8
tttaccctcagtccttcctcattccggggggggcccactcatacatataataactgtgttaaaaaaaaaaaaaatttataaacaaaaa

SEQ ID NO: 82410 - DNA, 247 bp, Zea mays
  Clone ID: LIB3114-018-P1-K1-G6
gcgtactcaaggatgttttgaggggaccaaaaccaattcaacacgaattgggtcgtcggtacatttgggtgcatgtgtcctgaatacgcgaggtggaaggcattttttcagtcaagtctgacgtctatggcttccgagtcctgatcttggagatcatcacaggaaagagggctgtgagctttcactgtcacgaggactccttgaacatcgctggatatgcgtggcggcaatggaacgaaaacaatgc

SEQ ID NO: 82411 - DNA, 99 bp, Zea mays
  Clone ID: LIB3114-018-P1-K1-G8
ctatttctagagcgcgagcggcctctctataggatccaaggttacgtacgcttgcgggcgggggtgataggtctggtgggggggcacctaaattcaatt

SEQ ID NO: 82412 - DNA, 266 bp, Zea mays
  Clone ID: LIB3114-018-P1-K1-H11
acgcctgcaggtacccgtaccggaattcccggggcgacccacacgtaacggaacggttcctgatgtaaaagccacatcaaaacgattttgggtcatcagctcccttgggtcagattttttgatcctgtgggtgttgagctatctctgttttcggtcattccttaatgcgcctcgtatttgtatacacatgtcggtttgtgccacctttaggtcatacacaccaacagtaggtaataaagctgtagccagtagttttccagaatata

SEQ ID NO: 82413 - DNA, 288 bp, Zea mays
  Clone ID: LIB3114-018-P1-K1-H12
ctgcaggtaccaattccaattccggcccgcgcccacgcctacgatactgcaaagcgtgcatatatacaatacaactgctgcgtactcttgcttatgcatgggtgcggacggtgttgctggcggtctggaaggagtccatgctgtaaaactgggcaggaagtcaaccagcaaacttgtgcattggtgacccattattccacatgcgaatcatacagatgatgtgggctctcgaatatgatcctggcatttcctccacttatgaagaggataatactggggctggggtcc

SEQ ID NO: 82414 - DNA, 150 bp, Zea mays
  Clone ID: LIB3114-018-P1-K1-H6
gacgccctctgtatcggcccattaatccccgcccgttgttgtcgttaccccccaaacgtgcccccttcacttgccaacgccctaaccccccctccttttgcttttcttcctttccttttttcgtcccgttcccccgctttttccccgtca

SEQ ID NO: 82415 - DNA, 418 bp, Zea mays
  Clone ID: LIB3114-022-P1-K1-A11
taataaaaaaaaaaaaaaaaacactaaataaaaaaaaaaccaacttacctatcaatttctagagaaaataaatacatcatttacaggtcccctatacttcaatttggttgctcatacttatctacaactattttaatttgaaaaaccttttcccttaacataaatttattatgctttgagggcctttcactcttttatcatcgcaatttctaatacccaaacagtcctatatctgtagcctcttttctaacacttacctaactttaattcactattggaccctttacaaaaccagtgcttaaacccctccggccttattgatacccctcatctaacccgacaccctcctaataccctatgccccagtcctttacatttcctcacttacctccctttccattattttctttttccccat

SEQ ID NO: 82416 - DNA, 212 bp, Zea mays
  unsure at all n locations
  Clone ID: LIB3114-022-P1-K1-A5
taataaatctagatctgcaagctgccacttctttatttttcaagcttacatacacatatcaagcaaagagagagnctctcctatagtaggacctagcttcaattcacttgccgtcgatttacaacttcttttactgttaaaacctaaattcattctcaatctcaattgttttacaacatcatcccttttaaaaccttgcctttacccaactt

SEQ ID NO: 82417 - DNA, 424 bp, Zea mays
  Clone ID: LIB3114-022-P1-K1-B1
taatgtagcttaataatgaactaggcgatccataaaacaacaaaaataaatagaccattaaggtcaaggggaaactcgagaacgcccgcgtattcaaccaggacaagtttccccacatgctttcagtgcggaactgcttcatcaggggctcggaggtgcagtacgtgctgctcccgcaggacggcgtggacatcgacatcctccacgacgccaccagtagggaggcgcgcggagagctgatcctgatgcgcacccgctccctcacctgctggctgctgcttcatccccgatagtacgaagcatgcatgtacggtgtgtggtagacagatgccccaatttagttatctggagctcgccttgacatataactttcaagttgggataagacctgaatcacctgatatattattgtcatatcatatgc

SEQ ID NO: 82418 - DNA, 411 bp, Zea mays
  Clone ID: LIB3114-022-P1-K1-B3
tattattgtctacaacaagaaacacccaaaacaccacataacaaaaactaccaacaaaataagagtaaagagaaataaccaaagagcccctcatcaacaccttcaagcaaccatgctccatttatgccgccggagatcccaagcatggccatggacgttccagtcctagactctacattcggatctgacgtacataatcaacctctacaattacgaccagatggctcctcacgaaactccattctattcttcacgcatttcttgaacttcagtctctcttatcaaactccacatacaacgcgttcataagatttgtacatcctacagaactacacattcacccctttcctgcctgcttactcatacattttgctcgacttctcataccaagaaaacccccctcttatcttt

SEQ ID NO: 82419 - DNA, 294 bp, Zea mays
  unsure at all n locations
  Clone ID: LIB3114-022-P1-K1-C1
ggagaagaggagggaggggaggaaatacgtggaaaaaaaaataaaacctgtacacgtgtatgtccagatcgcgtgccgtcgatcgttcttcgttgttgatttttggttgtattgatcgatccgtatgtgtgcgtgcgtgtgtggcgttgctctttcttcttttgtgtagctgccctgccaccggccgacgtgcatgccatggtggcggacagcgttttctaaggtcatatactggtgttgtgtttaagtacatcttgcgtactcaattccttctaagtaagtatcctaatnctt

SEQ ID NO: 82420 - DNA, 303 bp, Zea mays
  Clone ID: LIB3114-022-P1-K1-C3
gccaaacgttcggagggccttgaactcccgttcaggatccacatcttccctaccgagtggtggcgagacctcttcctcttaggaccacctccaaggctcttggtgtaagcttggggctgctcacctatcaagttctcatgtttgatctcggcattcagatcccaactgtctttgatccgttccctgaagccaatgctagggactctgttgccaaagcttggtcaaaggacaacctgcacgtgcgcatacataaacgttttggacgcaagaccctttccaccagttagggattgaagaaagagg

SEQ ID NO: 82421 - DNA, 135 bp, Zea mays
  Clone ID: LIB3114-022-P1-K1-C9
gactagttctaggccaagttatcctgttcgctaccgtgatgtttaccctagtccagagggtttatcttcgttcgtgtcgtgtttgttgttgcccatctgtgtttttgattgcaaggtcgctctgtgtcagttgtt

SEQ ID NO: 82422 - DNA, 113 bp, Zea mays
  Clone ID: LIB3114-022-P1-K1-D5
taaaaaaattttttttttaaaaaaaaaaaaaaaaaaaaaaaaagatccaaacttacttacagggtacaagacgacatacataacatgttctatagtctcacctaaattcaatt

SEQ ID NO: 82423 - DNA, 424 bp, Zea mays
  Clone ID: LIB3114-022-P1-K1-D8
gaagcattgttgaaaatgctctggcatcatccagatgctgttctgtgctgctcctttaaggagaaacctatgtttacgtttgcaaacaaggcagggctggacatgttagaaacatctcttgttgccctgcaagacctgacgctagacaagatcttcgacgagtcaggaaggaaagcactattctcagacatctcgaaactaatggaacagggctacgcgtacctgccgtcaggcgtgtgcatgtcaggaatgggccgccatgtttctttcgaccaagctgtagcgtggaaggtgctcggcgaggatagcaacatccactgcctggcgttctgcttcgtcaactggtccttcgtgtgactgacgcccaacccgtcgggtggttatggcgagctgaccctttttttgtatggaaaatcatcagctg

SEQ ID NO: 82424 - DNA, 55 bp, Zea mays
  Clone ID: LIB3114-022-P1-K1-E3
cactgtataatgaaacactccctgccgcggctcattaagctccgcgcatgtggtg

SEQ ID NO: 82425 - DNA, 310 bp, Zea mays
  Clone ID: LIB3114-022-P1-K1-E7
agcagcacatcccggggtatgccaagaagatcgtggaggcctacgacaaagacggacggatcgaggcaatggttacgcagtcaggtgactgactcacaccattcacactctactagctggtagtatttgtatactagctggtagtatttgtactgcattgtagtaaagattaaggaatgtagaagaattgtttgtgatgtgacgtagtggcgatgtatacagtagaatgtataggctgcatggcagcagctcagatctgtatgtacatcctgcgcttgccagtttctagtttgcatttgcttttctgggc

SEQ ID NO: 82426 - DNA, 334 bp, Zea mays
  Clone ID: LIB3114-022-P1-K1-F1
tcccacgcgtctctcaaaaaaaaaatttttctttttaaaaaaaaaaaaaaaaaaaaaaaaaaaggaccaagagttaataatacaaggttaaacacacctacacacacactacataactcttctataatgtcacctaaatctaaattaatgtgcctttgctttacaaacacaacgactaaaaaaaaccctaacgttacccccctctatcttaattttactacattcccctttccctttctggcgtaatagtaatatagatccaggcccatctccctttccaacactaacaccattctaaatatgaaatgtgacacaccctgtacctgtacattaa

SEQ ID NO: 82427 - DNA, 89 bp, Zea mays
  Clone ID: LIB3114-022-P1-K1-F10
atagcgagcggtctatatagaggatccaaacttacggacgcgggcatgctactacatagctcttctatactcttacctaaattcaattg

SEQ ID NO: 82428 - DNA, 85 bp, Zea mays
  Clone ID: LIB3114-022-P1-K1-G5
tgcgctgcctacggatctcgtaaatgagcccaaggttaatgcggtggcccatgctccacattgcgcactctggatagggaatggg

SEQ ID NO: 82429 - DNA, 305 bp, Zea mays
  Clone ID: LIB3114-022-P1-K1-H1
ctaatacttttatttttttaaacaatacatctaaaaaaaatctatcttacatacacatacaaagataaaagaaaacttcttctagagagaaaacttcatccctttttctgtccactaattttccaacttcttttctaaaaaaacccttacattacccaaattcatcaccttacctcacctacctctttcgctcactatcttaatacccaatattcctcaccaatcgcccttccccactttttcactaactcaatatctaatataacactccctttatcgtctcattaaacgcggcgcatatttaa

SEQ ID NO: 82430 - DNA, 371 bp, Zea mays
  Clone ID: LIB3114-022-P1-K1-H6
ggaagcagctgaagtctgatcctgtggattcagtcggatcgtggccatggcttaatttcgaccggacatgctgggcttccaccggacatgatgcataccaatcgtatttatgttgagttgtaatcgaacgctgcgtagcgcagtatcccgaagaacatatatatggggtcttctcttccgtttctgctctgctgtggtttcaataatcccgaaattgtgattccagtttaatataacaggccagcttgatggggctttcgttccaaaaaaaaaagcataaaaagcgccgggtgtgggggggatacgcacagtgagaccgatacttttgagagcgctatagcgcgcgccccttgcggtctttcctttctttt

SEQ ID NO: 82431 - DNA, 293 bp, Zea mays
  Clone ID: LIB3114-031-P1-K1-A1
ctaaaaaaaaaaaaaaaaaaaaaaaaaaaaaaaaaaaaaaaaaaaaaaaaaaaaaaaaagaaaaaagggaaaaaaggggagaaaataaaaattaaaaaaaaaaaaaaattaatgggggcggcccctttaaagaatccaatcttacttacgcttccatgcaacgtcataccttttctttagggccaccaaaattaatttcactgcccgtctttatacaacgtcgggactggaaaacccctggctttccccaacttaatccctttgcaacacatccccttttccccagttggctt

SEQ ID NO: 82432 - DNA, 89 bp, Zea mays
  Clone ID: LIB3114-031-P1-K1-A10
ggaaaggaccgaaaattgttggtatatgatgattatgtagcctcctgtttgcctggtgtgtttcaaatcaaagcaatgctcatgcatcc

SEQ ID NO: 82433 - DNA, 447 bp, Zea mays
  Clone ID: LIB3114-031-P1-K1-A12
aatgcgaagtgaaacaccaaaggatgatagcagacaagctgcttcaattttgttccctgacaaagatcagtccttgaagttgaaaaaacaccatgggcgagcagaggctcttctgttagcagcctatgggaaaggccttgtgctgccatcggggaagttcagcaaaacctcagtttgatgtctatggtgattgcagattgacttgccatttttttgggggtaaacagaggctcttctgttagcagcctatgggaaaggccttgtacgatgcctatggtgattgccgactgacttaccatttcctgtattgatggtactgcaaattttcatttcgcttaggaggccccaatcaagacattaaggttgaatctgctgtaagtttgcaaaccgtaatagagatcatagctaacccatcatttttcgtggaatgcattacagcattagaca

SEQ ID NO: 82434 - DNA, 77 bp, Zea mays
  Clone ID: LIB3114-031-P1-K1-A4
cttttacgcctgcaggtaccggtcactaattccctttctacccactcgtcctgaaaaatgaaagatcctgtacagat

SEQ ID NO: 82435 - DNA, 332 bp, Zea mays
  Clone ID: LIB3114-031-P1-K1-A6
gttgaacaagagtgggttcacatgggatccgaccaagatgatgattcagtgcgagaaacaaacataccttagtaattactttatgtaactagttttagtacatcgttttttatgtaatggtttgcctgtgacatgtgttttatatcgacagttcaatttgcttgtgtaaaaaaaaaaaaaaaaaaaaaaaaaaaaaaaaaaaaaaaaatggaggaagttttaaaaaaataaaagtttatgtacacttggatgcgaaatgtaatgattttttatagtgggacaattattataaatttttttgacatattttttaatggggggggcccttttaa

SEQ ID NO: 82436 - DNA, 332 bp, Zea mays
  Clone ID: LIB3114-031-P1-K1-A7
acccacgcatccgaaaaaaaaaaaacaaaacaaaataaaacaaacacctctactactacaacaagttcttgggcaacaaggggcagcgcttcaccaaacaacccctcaaacatctacatgcatgcccaagccctattcctataacgccgctaccgcctttaccttccacctcctcaactcatccaaaatcagaactcacacgacctttctattcgcgctacctaaaacaacaagtgcctccaggaacttaaaaactgggatcagtgaaaaaccatgctgttccaaactaaaatggactaccataaaaacccctatgatacgaaggactctaa

SEQ ID NO: 82437 - DNA, 372 bp, Zea mays
  unsure at all n locations
  Clone ID: LIB3114-031-P1-K1-B1
aaaaaaaaaaaaaaaaaaaaaaaaaaaaaaaaaaaaaaaaaaaaaaaaaaaaaaaaaaagagaaaagggaaaaaaagggatctggggttctctaaccccctcctctttctctcccnaccttttttctaatatccttcttttatattttcactctacatttaattcactacacctcttttttacatcccccttcctttataaaccctaattttccctcacttaattccctttcctactcttccccttttctccacccaactttttacccttttctcctttccacaaatccttttcccaaataatccctttctcctatcccattatttttcccttcctttctatttctcctttttattccttcccttatttttt

SEQ ID NO: 82438 - DNA, 183 bp, Zea mays
  Clone ID: LIB3114-031-P1-K1-B10
acgcctgcagtaccgttccttaattccgcgggtcgacccactcagtccgaaaaaaaaaaaaaaaaaaaaaaaaaaaaaaaaaaaaaaaaaaaaaaaaaaaaagaaaaaaggcaaacatacgatggcatccatcctacttcctcttccattcttcctcctaatttttttttactttcccctaaa

SEQ ID NO: 82439 - DNA, 127 bp, Zea mays
  Clone ID: LIB3114-031-P1-K1-B12
aaaaaaaaaaaaaaaaaaaaaaaaaaaaaaaaaaaaaaaaaagggcgaccaaggtagagggtccaagctgacggacgcgtgcatgcaaacaccatatctcttctataaggggcgcctaaattcaatt

SEQ ID NO: 82440 - DNA, 73 bp, Zea mays
  unsure at all n locations
  Clone ID: LIB3114-031-P1-K1-B5
tctagaggatccaaggttacgtacgcgtgcgggcngcgtcataggtggtctataggggcacctaaattcaatt

SEQ ID NO: 82441 - DNA, 277 bp, Zea mays
  unsure at all n locations
  Clone ID: LIB3114-031-P1-K1-B6
tactcctgcattacctttccctaattcccntgtcgacccactcgtccgaaataaaaataaataaaaaaaaaaacaatataaaaataaacaaaaatacatacacataaggtacaaagtcaaaactaatatgtggggttctccctacattcattttctacttacctttcttttatacttcttcattatctaataaattcctgcccccctttaaaataaccaaatttaactaccatctcccattaccaaaaattatatcttttttttttttttcacccca

SEQ ID NO: 82442 - DNA, 389 bp, Zea mays
  Clone ID: LIB3114-031-P1-K1-C1
aaaaaaaaaaaaaaaaaaaaaaaaaaaaaaaaaaaaaaaaaaaaaaaaaaaaaaaaaaaaggaaaaagaaaaaaaggggtataaaaattaaaaatatattatatttaactaaaacttttctatacatttacatcgtcttctctttacttttccctttctttaccctacttattctccttccattacatccctctttctccacctatcttcatttctatcatgccctttcctatctcccttccctacaattcctcatccttaacctttattattaccctcccttcaacttctcatttaccccttctttttttttcttactctcatcttttcctctacacttcccaactccctatctccctctcctttttttgtcttccctttcttttttc

SEQ ID NO: 82443 - DNA, 164 bp, Zea mays
  Clone ID: LIB3114-031-P1-K1-C3
caaaaaaaaaagaaaacaaaaaaaaaaaaaaaaaaaaaaaaaaaaaaaaaaaaaaatcaagagaaaagaaaaaaatagagaacaaagtgtggatattatttatttattctcttataaacttattttttatctccattcttttcctctttaatctaaaatttttt

SEQ ID NO: 82444 - DNA, 268 bp, Zea mays
  Clone ID: LIB3114-031-P1-K1-C4
taaaaaaaaaataaaaaaaaaaaaaaaaaaaaaaaaaaaataaaaaaaaaaaaaacaaaagggtaagaaaaaaacaaaattaagtgcacttccttacaacattattaactattttttaatttaccctaaatttaattcactttacctaatttttacatcgccctttactaaaaaaaccctttctttccccatcttaatcacctttaatcttttccaagttttccccaatttactttatttcccacgaatttccccacctttttccctt

SEQ ID NO: 82445 - DNA, 422 bp, Zea mays
  Clone ID: LIB3114-031-P1-K1-C5
ttttcttttctccttcttttcctttcctttttccctttcttccctctcttccgatttttttttttttttttttttttttttcttttttttttttttttatttttttttattttttttttttttttttttttttttttttttcacttctttttttttttttctttttttttttcttttttttttttttcttttcttttttttctttttttcctttttttttttcttttttttttctttttcttttccttttctttttttttctttttctttctttttttctttttttccttttttcttttttttttttttcctttttttttttttttttccttccctttttcttttttttctttttttttttctttttcctttttttccctctttctttgcttttttttctttttttctcttttttttttttt

SEQ ID NO: 82446 - DNA, 417 bp, Zea mays
  unsure at all n locations
  Clone ID: LIB3114-031-P1-K1-C6
aaaaaaaaaaaaaaaaaaaaaaaaaaaaaaaaaaaaaaaaaaaaaaaaaaaaaaaaaaaaggaaaggaaatntgggggcttttgtggagtcccaattttacttccccttaaatccaactttatatcttttttatatggacacctaaataaaattcactgcccgggttttaaaaccgtatcaactggaaaaaccctggcttaaccaaactaaatccctttccagaacatccccctttccccatttttcataataccaaaaaggcccattcctatcccctttccaaaaactttctcaccctaaattccaattgtaacgcccctttaaacccttattaataacaccgtttttttttggttacccataaattaaactcttcattttcaagccctttttccccccttttcttccattttttt

SEQ ID NO: 82447 - DNA, 382 bp, Zea mays
  Clone ID: LIB3114-031-P1-K1-D11
aaaaaaaaaaaaaaaaaaaaaaaaaaaacaaacaaaaaaaaaaaaaacaaaaggacatgggcaaacatgcggaaagaataactcttatataaaaaaaacctaaattaaattaaactaaaccaaaaatatacgggccgcccgtcttaaaaatcccatgttttttcccacctgaatcccctttcaaaactttttttttttggccccaaattttatttccttggccgccctttcccaacgcctttcctgaaaaaccccctgccttcccaacttatatgactttccataaattccccctttacccacttgggtttttatgaaaaagccccgcacgaatcctcctttcaaaaatttcccaaccctaattggtaattgttacccccct

SEQ ID NO: 82448 - DNA, 353 bp, Zea mays
  Clone ID: LIB3114-031-P1-K1-D12
agttccgtcacgacgaaggaagaagggcgtgtgaggcagaaaattatactggtgtggtttttcattgggtttttttcttcttttgcttcgttttcttttctttttcccagtagattgccgtgagtagacagtgctggcttttggaattcagacgtgtatgtggcgtaaaatgaattccaagagctagcagtgccattctttctcttctcagcctaccctatttgttgtctagtccttttgtcttctctttggcgttctagacgcccgggaagtagaatggacagacgaacaccaccagtgtgcagttcacatgactagagagaactatcgaccaagtgtgaattactgtttgt

SEQ ID NO: 82449 - DNA, 272 bp, Zea mays
  Clone ID: LIB3114-031-P1-K1-D3
aaaacctataattaaatataaaacaaaaactacttaaataaaatgataaaaatcctacttataggcaaaaggaaaaataataggtcgggtctttcctaaccttaaatttttttattcttttatctactttcaatctgcctgcccctctatatttaccaatcttccttactctttcatccgccattatatttctaatttcgtttctcctaattctaatttacttgccttatcttttacatcttcacaacttttaaccctttcccatttcccat

SEQ ID NO: 82450 - DNA, 484 bp, Zea mays
  unsure at all n locations
  Clone ID: LIB3114-031-P1-K1-D7
gcgtacgtaagctgggggttcggggcgagtgatttngaataaagcattgtttcttctccacttatggagcatttgcctccacatccgatcatggtgcaggggggtgttgtcancttcatcaacagttgccagaatcaatgattgagttaatttcacaagataatccgttgccagaaaagggtaagcttttgcaagcagtgatgaaagctggtcctttgcttcagacactgattcttgcatgaccacttgctcaatggagacaccctccaccccctgttgagtcctttgagattgcacctgtcaccattcttttaccaccaccacatcaacaacttcgtcaagagtccttcatcaccttcaacttgtggagagttagtgggagaagggttttctttgagggcactgattcttccactcagaacaaggttcataggatttgactccaatgacaactactactaaactgggactaaagtcaggttta

SEQ ID NO: 82451 - DNA, 214 bp, Zea mays
  Clone ID: LIB3114-031-P1-K1-D9
gtcgggtgtcaaagtgttatattaccatgaggcggaggtagcttgactgattggtgctatattttatgctgcagttcaagtgatttatgtggtaaaaaaaaaaaaaaaaaaaaaaaaaaaaaaaaaaaaaaaaaaaaaaaaaaaaaataaaaaaaaaaaaaaaagtgaataaagtatattaaatgattattatatttaaaatagaatgcgatat

SEQ ID NO: 82452 - DNA, 273 bp, Zea mays
  Clone ID: LIB3114-031-P1-K1-E1
aaaaaaaaaaaaaaaaaaaaaaaaaaaaaaaaaaaaaaaaaaaaaaaaaataaaaaaagaagagagggcctacatgggggtgcggcctcatctctctctcttacccctcacctaaatctattttatttagccaccattttacaacttttctgactacaatattccctaccctttcccaacttaatacccctttcaccccatcccatttttccccatctccccttattccttatacgccctcactctatcaccctttccaacacccccctcatc

SEQ ID NO: 82453 - DNA, 365 bp, Zea mays
  Clone ID: LIB3114-031-P1-K1-E10
aaaaaaaaaaaaaaaaaaaaaaaaaaaaaaaaaacaaaaaaaaaaaaaaaaggggaaagtgataaaaaagaggcagagccccacaaataaaccaaacaattaaacccggtcgcccactttaaagataccaaacttacctccccttccatccaacgtaataatttttttttctggccacctaaattcaatcaactggcccgattttaacaacaccctaactggaaaaacccttgagttacccaatttaatccccttgaaacatatccccttttccccagctggattattaccctaaaggccccctccaattatctttccaaacattttcccaatctaaattgcaaatgataccccccctttacccg

SEQ ID NO: 82454 - DNA, 296 bp, Zea mays
  Clone ID: LIB3114-031-P1-K1-E11
gcaagaagaagtccgcaggcgacgccctcccggtgtcacagatgcctgacaaggagacggatccgctgttggcgaccaaggacaacagcgacaccaaaaaggcgaacggggttgctcacgactgctaagatgttcccgtttgccgttgcttatagcctaattagtccagctctagtgttactacgacgcactgttctgaatctcagaaagtcagggaagaagtcattcctttttgtttcttataatattgtatatgtaatattcctctattgcgaattataagccgtttcaatttt

SEQ ID NO: 82455 - DNA, 207 bp, Zea mays
  Clone ID: LIB3114-031-P1-K1-E12
aaaaaaaaaaaaaaaaaaaaaaaaaaaaaaaaaaaaaaaaaaaaacataaagaggaaaagggaacaaagtggaggagaaaaaaaacgtccggccgctcctatagttccaacctatcttccccttgcttcccacatattcccttttctattgggtcactctactttcaattcactgtccattgtttctcaacttccctactttaaatc

SEQ ID NO: 82456 - DNA, 272 bp, Zea mays
  Clone ID: LIB3114-031-P1-K1-E2
tttactccttcagtacccttccctaattcccgtgtcgacccactcgtccgaaaaaaaaaaaaaaaaaaaaaaaaaaaaaaaaaaaaaaaaaaaaataaaaaaaaaaaaaggaatataggcctacatgtcacgtgcgatactcttctatatttatttcctaatttcactctaatttcacttctctttccaactactttcaatcctaaaaccctcctaattccccaacttatacctattttaatcacacttttctttttcctcctttttttata

SEQ ID NO: 82457 - DNA, 97 bp, Zea mays
  Clone ID: LIB3114-031-P1-K1-E3
aaaaaaaaaaaaaaaaaaaaaaaaaaaaaaaaaaaaaaaaaaaaaaaaaaaaaaaaaaaggaaaaggggaaaaaaaaaaaaaaggggaaaaaaaaaa

SEQ ID NO: 82458 - DNA, 172 bp, Zea mays
  Clone ID: LIB3114-031-P1-K1-E4
ttttaggggttcctgctttcctgccccggccttgcgcctccttccctttctcttagggccccctatttcctttcccctggcctccgtttaccacctgctgttctggaacacccctgccgttcccccccttattttccttcccttttttccccctttagcccatttgggttat

SEQ ID NO: 82459 - DNA, 56 bp, Zea mays
  Clone ID: LIB3114-031-P1-K1-E6
aaataaaaaaaaaaaaaaaaaaaaactatataaaaaataccaaaaatttcaaacac

SEQ ID NO: 82460 - DNA, 306 bp, Zea mays
  unsure at all n locations
  Clone ID: LIB3114-031-P1-K1-E7
aaaaaaaaaaaaaaaattaacataaaaaaaaacaatacataaaagcaaaaactgcaagaagtaaataactggccgggggaacttaatcttncttctcccccactttatgttcttaccacccatacactggacaaggagcaatgaatattggttctcaacaatcccataacttcccgcacttaaacaatacaacaacacaaagaccctcttctggtcaaagattcatctagagcaacgaattaaccttattatcaattgcttgcttagcacatagctcagctacgccaagatatttaataagtcatt

SEQ ID NO: 82461 - DNA, 75 bp, Zea mays
  unsure at all n locations
  Clone ID: LIB3114-031-P1-K1-E8
tctaggagagtccaagcttactgacgggttcgggcnacngcataggtgggtctataggggcacctaaattcaatt

SEQ ID NO: 82462 - DNA, 362 bp, Zea mays
  Clone ID: LIB3114-031-P1-K1-F10
atcagttcgtccttgcaaaacaaagaatataaaaaaaaacaaaaaaacaaaggcaaacgtacaaaaatgagaaatataatataaaaaaaaactaaattaaattcaactaaccatcattttacaactaaaataactaaaaaaaaccataacattaacccaacttggtcccctttcataacatcccaactttctccacctgtcattataacttaatatcttttttctgttcccccttaacaacatttccgcagcctgattttcaaatggtactctcaaaaaacccctgcattcaccactttaattgttgtggaaacacaccccttttccgccacttttttcaataccataaggccccccccttt

SEQ ID NO: 82463 - DNA, 439 bp, Zea mays
  unsure at all n locations
  Clone ID: LIB3114-031-P1-K1-F3
gcctgcggtaccggtcctgaattcccggggcgggccacgcgtgcggccaaagcgaaactcatggaaatcaacaaggagcagtccaagcgtggcaagtanccagggggacggggatnaaacgggtgggggaaaccactccacaaactaaaaaaaaataccctaagctggcaaactggcctatgactaacccacaagggggagggcggggctcactgggggctgctctttccgcacgaagggagactagagcggatgtggtcttcacggtttggtctatgccagatactagcgtcatgaactggctttaggtaagattttccataacttggtctccatcagctatatggcgcatggtggctacttccaaacttatatctggttttgggtcgggatcggggtgaactaattggctcttcgaatttatatcatgatgggggcg

SEQ ID NO: 82464 - DNA, 143 bp, Zea mays
  unsure at all n locations
  Clone ID: LIB3114-031-P1-K1-F6
gcctcagtacctttcctggattcccggggcgggccacgcgtgcggactagtgtctagatcgcgagcgggcgctctaagtgatccaagcgtactactctgcgggcgngcggcataggggggtgtaggggcacctaaattcaatt

SEQ ID NO: 82465 - DNA, 292 bp, Zea mays
  Clone ID: LIB3114-031-P1-K1-G1
ttccttaattccctgtgtcgacccactcgtccgaaaaaaaaaaaaaaaaaaaaaaaaaaaaaaaaaaaaaaaaaaaaaaaaaaaaaaaaaagaggactgtgtaaaaaataagaaacttgccttccctttcatcctaacatctaactcttatatattctttccttaatttttcttccctttttttattcttcacactcctctttactcttccttactttttcttattcccatctttttctcccctacacttttttttctctttcccccttttttaaataatatcctatctttt

SEQ ID NO: 82466 - DNA, 506 bp, Zea mays
  Clone ID: LIB3114-031-P1-K1-G11
tttactcctcactcctcctctcccattccgcaattcccgggtcgacccactcatcctaaataaaaataatatataaaaaaaacaatataaaaaataaaaaacaaaacatgggcgtagagtccaacataagaactcatactttcaaaacccccatcattccaatttcactccctcttctattttcaacccataaatctatttctctccctcgcgtttctacaactttcttccctttcaaaacacttccctttttcccaacttaatctactatcaaaacatcccccttccttcacccttcctatcacctaaaaaacccccactttataacccttcccacctcttacccccccttatattcccattttctctccctttttcactcatcattatcccctcccttttttatattcatacaccctctcacttttattttttacatacccctttcaccccattttttttatttcccccctcttttttttttcccattctccccttttcccttt

SEQ ID NO: 82467 - DNA, 435 bp, Zea mays
  unsure at all n locations
  Clone ID: LIB3114-031-P1-K1-G12
acatcgaggaagagatgcgcaggaagcaagctcacgcttcccattatgcgtgcgagggggactacgagatgcgcgggcggagcccatagagtgcagtgcgcgcaacagtaagcagactatcatcaaggcaattgggaggggtggtgcccttaaagcatgggagtgatctctggttttgctgtcgccgagctgggaaataggaagctgaatcgacctcgcaagcggggaatgtatccttttttgctgcaacataaaaaatgctacccaggcatagctgggtaccttttaacttctgtttgtgggatttgctagagtgatggtttcgatatatagggggacttgaatgtctggaatgctacggtataacgcacatttgggtgcaatgtctgttgcattgctgtctgaatgacatncgtggtacatttattttcatgt

SEQ ID NO: 82468 - DNA, 221 bp, Zea mays
  Clone ID: LIB3114-031-P1-K1-G2
tgtacgcctgcagtaccgttccggaattccctgggcgggccacgcgtccgaaaaaaaaaaaaaaaaaaaaaaaaaaaaaaaaaaaaaaaaaaaaaaaaaaaaaaaaaaggggaaaggggaaaaaagggggaaggggaagggccgcccctctaaaggatccaaacttacctacccgtgcatgcaacgtaataacttttttataggggcacctaaattcaatt

SEQ ID NO: 82469 - DNA, 505 bp, Zea mays
  Clone ID: LIB3114-031-P1-K1-G3
tttactccttcattacccttccctaattcccgtgtcgacccactcgtccgaaaaaaaaaaaaaaataaaaaaaaaaaaaaaaaaaaaaaaaaaaataaaaaaatactatagaaaatagtacaatataataggggggtcttcctctttttctcttcttttttttacttccccttccttctcttctcttccccttttttttcccctaccttactttaattaacccccttttcacacattccccctttctcatctttcctaatatctaataatcccccacctatcccccttaccaactttttcccatccttaatttctaattgtacacgccctttatcgtctcattaaacccctactttttcttttttttactctcaacgttttccctttcactttccaaaattttcctcaccccttttctattttctctcttccctttcttttttaccttatttcccaccttttttccctctttatcccctttttttccccttctttttttattatt

SEQ ID NO: 82470 - DNA, 280 bp, Zea mays
  Clone ID: LIB3114-031-P1-K1-G4
ttactccttcattacccttcctgaattcccttgtctacccactcgtccgaaaaaaaaaaaaaaaaaaaaaaaaaaaaaaaaaaaaaaaaaaaaaaaaaaaaaaaaaaaaaaaaaaaaaaaaaaaaaaaaaaaaagaccattctctcttactaattcaaccatccttaacttcttatctctaccccctccttaatttaattcactacccaacctatttcaactaccccacatttataaccccttccccacctaataaaatcactttccctcacataaccct

SEQ ID NO: 82471 - DNA, 399 bp, Zea mays
  Clone ID: LIB3114-031-P1-K1-G7
ttcacactacctacttcatacttccggggtcgacccactcatcctcccactcgtccgaaaaaaaaaaaaaaaaaaatataaaaaaaaaaaaaaaaagggaatatgaaaaaacaaaataaatgatttatttaatttcaactcactcacaatttaaatggcttccatctcttctatagtttctctgattcttcctttttctacttcttcactttcatctaatgtcataacaaaaatcttcccacacagccttttattctctacatcacaactttattaacacattattcacacaaattcattttcattcgcaccatccttctttctcattcctttatttattacccctaaacccatttttgcatcctataaatactatacctattctttatttcttattct

SEQ ID NO: 82472 - DNA, 408 bp, Zea mays
  Clone ID: LIB3114-031-P1-K1-H10
ctttactccttcatttcccttccctaattccctgtgtcgacccactcagtccgaataaaaaaaaaaaaaaaaaaaaaaaaaaaaaaaaaaaaaaaaaaaaaaaaaaaaaaaagatcaatcctactactttgttcctccttctttcttcccttccttaccttccctttatctttttttttctattaccttatcttcaattcactttcctatcacttttctttatcatcccttttcaaacccttccttttcccaacccttttactatccctttcatccccctttctcttcctctccttaatcccttataacccctttccttttctctttctccttctcttcttcttcccttattcccctcttttttcttccctctttttcttatctctttccctctccacctcttttttt

SEQ ID NO: 82473 - DNA, 150 bp, Zea mays
  unsure at all n locations
  Clone ID: LIB3114-031-P1-K1-H11
tgtacgcctgcattacctttcctgaattccctagtcgggccacgagtccgcacttcctctatatccccaccccacactctaaaagatccaagcttacttactcttgcgtgcgacgtcataggtggtctatantntcacctaaattcaatt

SEQ ID NO: 82474 - DNA, 352 bp, Zea mays
  Clone ID: LIB3114-031-P1-K1-H2
aaaaaaaaaaaaaaaaaaaaaaaaaaaaaaaaaaaaaaaaaaaaaaaaaaaaaaaaaaaggaaaaaagaaaaaaaaagaaaaggggaaaaaaaaaaaaaaaaaaaaaaaaaaaaaaaaaaaaaaaaaaaaaaaaatggggccccccttttaaagaaccaaattttacttccccttccttccaacttaatacttttttttttgggcccccaaatttaattcccctgcccgttttttaaaaccttgttaactgaaaaacccttggcttacccaaattaaatccctttgaaaaaattccccttttccccatttggcttaataccaaaaagcccccccccattcccctttccaaaa

SEQ ID NO: 82475 - DNA, 176 bp, Zea mays
  Clone ID: LIB3114-031-P1-K1-H3
aaaaaaaaaaaaaaaaaaaaaaaaaaaaaaaaaaaaaaaaaaaaaaaaaaaaaaaaaaagggaaaggggaaaaaaaaaaaaagaggaaaaaaggggcgccccctttaaaagatccaagcttacttccccttccatgcaacgtcatagctcttttatagggacacctaaattcaatt

SEQ ID NO: 82476 - DNA, 293 bp, Zea mays
  Clone ID: LIB3114-031-P1-K1-H7
ccacgcgtccgaaaaaaaaaaaaaaatatataatataaaaaactatataaatttgatataacggggtcgggacaaggagagtgcggggttgatttggaaatccaggtccccaccccattctacccgtttgcctaggcgagagaatcagatgcccccgtagcataggagtatgtacatattctaattcagcagaggaatgacaagaagagtctgaccacagcgcatgggctgaacaatgagttcagcttcgagaagatcctcattgtcctcaagaaggagttctgctacaacgg

SEQ ID NO: 82477 - DNA, 489 bp, Zea mays
  Clone ID: LIB3114-031-P1-K1-H8
ttactctttactccttcagtaccgttcctgaattcccgtgtcgacccactcgtccgaaaaaaaaaaaaaaaaaaaaaaaaaaaaaaaaaaaaaaaaaaaaaaaaaaaagggaaaaaggaaaataaaaaaaaggggaaaaaaaattggccttcctttctatttcttccatccttcccttccctttcatccgactttttatcttttctattttttcacctaatttcaatttactggcctcttttttacaacttcttatcttttaaatccctttcccttcccaatttattttccttttataccatcctcttttccccattttgattaattaaaataaagccccctcctttcctccttcccatatatttaactttcttatttttctttttccaccctcctttttttccccttcataaacccctgggtttttgtttttttccctacctagttaacctttttttcttgtcaatcttcctttccccccaatttttt

SEQ ID NO: 82478 - DNA, 59 bp, Zea mays
  Clone ID: LIB3114-032-P1-K1-A1
gcctgcagtaccggtccgggattccgggtcgggccacgcgtgcgcccacgcgtgcggac

SEQ ID NO: 82479 - DNA, 85 bp, Zea mays
  Clone ID: LIB3114-032-P1-K1-A11
aaaaaaaaaaaaaaaaaaaaaaaaaaaaaaaaaaaaaaaaaaaaaaaaaggaaaaaaaagaggaaaaaaaaaaaaaggggaaggg

SEQ ID NO: 82480 - DNA, 66 bp, Zea mays
  Clone ID: LIB3114-032-P1-K1-A2
ttacttaatctccacactcaataatctatccctaagcatccccagtatttctcccaatctaaaata

SEQ ID NO: 82481 - DNA, 225 bp, Zea mays
  Clone ID: LIB3114-032-P1-K1-A3
gcctgcattaccgctccttaattcccgtgtcgagccacgcgtgcgggctagctttatatctcgagctgcctctctataggatccaagcttacttactcgttcatgccacttcatgactcttctatagtgtgcacctgaattcaattcacttgccttcattttacaacgtcttaactcgtaaaaccctggcattccccaacttaatccactttcatcacatccctc

SEQ ID NO: 82482 - DNA, 95 bp, Zea mays
  Clone ID: LIB3114-032-P1-K1-A6
cgcctccaggtaccgttccggaattcccggggcgagccacgcgtccggaaaaaaaaaataaataaaaaatgtagcggaaataaaaaagaaggcat

SEQ ID NO: 82483 - DNA, 222 bp, Zea mays
  Clone ID: LIB3114-032-P1-K1-A7
atggtttggtactttgttctgtcatcactcgtttatctatccctaatgcatgcctccatgattggactcccaaaaaaaaaaaaaaaaaaataaatgaaattcaataaaaaaaaaaaaaacaaaaataaaaaataaaaaaaaccgtagaatttctaaaatatattaaacttaaataaaattacttgtttaaccaatttaaattaataagatatgaggaaccca

SEQ ID NO: 82484 - DNA, 77 bp, Zea mays
  Clone ID: LIB3114-032-P1-K1-A8
aaaaaaaaacaacccatatataaaaaaactaaaaaacatacacaaaaaatgaaacaatataggtttttattaaatat

SEQ ID NO: 82485 - DNA, 186 bp, Zea mays
  Clone ID: LIB3114-032-P1-K1-B1
attattatcaagggtgcttacactctataatatccacccttacgttcacttacggggtgcgtcatctctggggtatgtatcacctaaattcaatttacttgcccttgttttacaacatcaagactggtaaaaccctggctttacccatcttaaattcctttcaacacattcccctttccccaactt

SEQ ID NO: 82486 - DNA, 99 bp, Zea mays
  Clone ID: LIB3114-032-P1-K1-B11
aaaaaaaaaaaaaaaaaataaaaaataaaaaaaaaaaataaaaataaaaaggaacttcatggcgttttatataatcctagcttactttcacttcctttc

SEQ ID NO: 82487 - DNA, 150 bp, Zea mays
  Clone ID: LIB3114-032-P1-K1-B12
aaataaaaaaaaacaatataaaataaaacaaactttcaaaacacaaaaatgagaaattttgagcttgggactaaatcatctatattcaattctctttccataaattctcaactgactgctgccaaatcattcccgtttcccttccaagaa

SEQ ID NO: 82488 - DNA, 71 bp, Zea mays
  Clone ID: LIB3114-032-P1-K1-B4
taggggatcgggggttgcgtacccttccttcccacttcatagctctcctatatgggcacctaaatccaatt

SEQ ID NO: 82489 - DNA, 70 bp, Zea mays
  unsure at all n locations
  Clone ID: LIB3114-032-P1-K1-C2
tctagaggatccaagcttacntactcgtacggacacttgggggtggggttangggcacctaaattcaatt

SEQ ID NO: 82490 - DNA, 72 bp, Zea mays
  unsure at all n locations
  Clone ID: LIB3114-032-P1-K1-C3
tctagaggatccaagcttacagactcntagaggggggggggtattttgggggataccatctctaaactcaat

SEQ ID NO: 82491 - DNA, 422 bp, Zea mays
  Clone ID: LIB3114-032-P1-K1-C4
cgcctgcaggtgccggtccgggattcccggggcgggccacgcgtgcgaatagtcttgggcactacactgtgccagaggagatggatgaaggttgcaaatggatcgggggaaatttggggcgtgggcgactaaggcatcttgattggaatttgatgcgagaaagactcggagggacggggtccaaataataccggtatcttttccaggagggatatgggttaatagcaaatttgggcttgggtatacgggcatgttctagcttttcttaacgcagacgtgtctgggaatggtggatgcttataatatctatattttgggctacggcgatttgggtggggcacggataatggttggttcaaatattctggtctgcgaattggaattgggatggtttggtttaaaaaaaataaacattagggggt

SEQ ID NO: 82492 - DNA, 75 bp, Zea mays
  unsure at all n locations
  Clone ID: LIB3114-032-P1-K1-C5
tctagaggatccaaggttacgtacgcgtgcgtggcggacntcatagctctggtatagtgtgacctaaattcaatt

SEQ ID NO: 82493 - DNA, 276 bp, Zea mays
  unsure at all n locations
  Clone ID: LIB3114-032-P1-K1-C6
attttgtccaaaatgctattctgaatctgagatagtgttgtattctgatacacaaacagacaaaatcataaaaaggggtaaaaaaaaaactaaataaaaataaataaaactaaatattacaacaatttacagtggcaaaacccntggcttcacccaacttcttcgctttgctgctcctactcttttctctcttttcgtgcactagctaatattccctaaccggtctttttatccaactggtgggcagccttaatggcgtttcggaccttccctttc

SEQ ID NO: 82494 - DNA, 131 bp, Zea mays
  unsure at all n locations
  Clone ID: LIB3114-032-P1-K1-C7
cgcctgcaggtaccggggcggaggtcacgcgtgcgggcctcgcgttcgatcacaagcggccgctctataggatccaagcttacttacacatcgggcacntcgggggtggtatagggggcctaaattcaatt

SEQ ID NO: 82495 - DNA, 84 bp, Zea mays
  Clone ID: LIB3114-032-P1-K1-C9
ttcccctttcttccaacctcttaccttcttctttaatacaaccttaaatgcaattcccttgccgggtttttacatcgttcggcc

SEQ ID NO: 82496 - DNA, 158 bp, Zea mays
  Clone ID: LIB3114-032-P1-K1-D1
tcccaattgcaccccccccttttctccacattaaacccccctttgtttttttgttacccccatcttttacctatacatttttccaatcgccctattctccccatttcttttaattttcttccccttactttttatcccaccctttccccctgttttcc

SEQ ID NO: 82497 - DNA, 376 bp, Zea mays
  Clone ID: LIB3114-032-P1-K1-D11
aaaaaaaaaaaaaaaaaaaaaaaaaaaaaaaaaaaaaaaaaaaaaaaagggggaaaataggaacatagggaaatatgagggacataaataaaaaaattagacaaatatttaaaaaaacaatattatggggccggcctttttataggaccaaagtttattaccccgttcatacaacgatatacctctttttttgggaccccaaaattaatttaacgggccggattttaaaaacgtgggaactggaaaaaccctggggtccccaaatttaatgcctttgcaaaaattccccttttaacaagttgggttaataacaaaaaggccccacccattcccctttccaaacattttcccacctttattggcaaatggacccccc

SEQ ID NO: 82498 - DNA, 449 bp, Zea mays
  Clone ID: LIB3114-032-P1-K1-D12
cacagtcctacgagcagtcgcacgcaagtgtcaagagacgaaacggtcgacatggctggcacgcaatctgccggagcggtcgccgtggtggccgcggtgctgctgctggcagcggcggcgacgacctcggaggccgccatcacctgcgggcaggtgagctccgccatcgcgccctgcctctcctacgcccgcggcacggggtccggcccctccgcgtcctgctgtagcggcgtcaggaacctcaagagcgccgccagcaccgccgccgacaggcgcgccgcctgcaactggctcaagaacgccgccaggggcgtcagcggcctcaacgccggcaacgccggcagcatcccctccaagtgcggcgtcagcatcccctacaccatcagcacctccaccgactgctccagggtgaactaaaacctagaccacgcgcgacgacgggcggctga

SEQ ID NO: 82499 - DNA, 73 bp, Zea mays
  unsure at all n locations
  Clone ID: LIB3114-032-P1-K1-D3
tctagaggatccaaggttacttactcgtacggtggacntcaggggtgtggtatagggtggcctaaattcaatt

SEQ ID NO: 82500 - DNA, 311 bp, Zea mays
  unsure at all n locations
  Clone ID: LIB3114-032-P1-K1-D5
aaaaaaaaaaaaaaaaaaaaaaaaaaaaaaaaaaaaaaaaaaaaaataaaacaaccaatttgagatatccagagcattaggtacactacagttcntcctattttctcttcctttttttattttcaattcttttcaccctcctttccttaatatcaccttttctttaataacacctaaatctatcatcttccccccctttcacaacattccccttttaaaaccctctgtcttcccaaatttaatcttctcgatctccctccccttttttccatcattcttaatatcaattatccccccccctttcccccttc

SEQ ID NO: 82501 - DNA, 317 bp, Zea mays
  Clone ID: LIB3114-032-P1-K1-D7
tcccctgtcgacgccacgcgtccgaaaaaaaaaaaaaaaaaaaaaaaaaaaaaaaaaaaaaaaaaaaaaaaaagagaaaattcaaggaaggggtaaatatcaggccttccttcccctctcatcctacctcaatttctcttcttttttaccactttttattaaatttattccctcatttttctccatctttatatatttataaatacccctctcttttcccaccttataccccttccttcttatcccccttttatcaaacttccttattccccattaataccccctctccttcgtctttcccatcttttacccccccc

SEQ ID NO: 82502 - DNA, 220 bp, Zea mays
  unsure at all n locations
  Clone ID: LIB3114-032-P1-K1-E1
aattcccgggtcgagccacgcgtccgaaaaaaaaaaaaaaaaaaaaaaaaaaaaaaaaaaaaaaaaaaaaaaaaaaaaaaaaaaaaagaaaatccagaaattttgagaaatccaaccttacttccccctcctttcaacntcttatatttttttatattctcaccaaaattcaattcactcccctttattttacaaccttttaattaaaaaaacccccact

SEQ ID NO: 82503 - DNA, 391 bp, Zea mays
  Clone ID: LIB3114-032-P1-K1-E3
aaaaaaaaaaaaaaaaaaaaaaaaaaaaaaaaaaaaaaaaaaaaactacaccaacaatatagaaaatccaaacttactagacacactcatttctaattcattcctctattttcgccctccctttattataattcaatattcatctcctcacaactcccacatctaatttttcccttaaattccccaaattaaaatctcttcacctctttttaccaacctccaactttgaaaaaccctacatttccccaattaattcccctttcaaccaatccccatttcccatctccctttataccaaaaatccccccccccataacctttccaaaaattttcccaaccctaattataaatcgacccccccctttatccctatttaacccacctttttttt

SEQ ID NO: 82504 - DNA, 488 bp, Zea mays
  unsure at all n locations
  Clone ID: LIB3114-032-P1-K1-E4
cgcctgcagtaccgttccggaattcccggggcgggccacgcgtgcgaaaaaaaaaaaaaaaaaaaaaaaaaaaaaaaaaaaaaaaaaaaaaaaaaaaaaaacattgggggccncctgcgttttgttttttttgggacatataaataaataaatagatttatttcgtattgcgatagatacaaaaaaagctcaatgcaaaaaacaaaagggggggggtttcgcgtgcggctggggggacttttctatgctaccggcacggagtccggcccctcctcttcctgctgtagcggcgtcaggaacctcaaaagcgccgtcagcaccgcctgctacaggtgcgccggctgcaactgtcttaagaacgccggcaggggcgtcagcggcctcaacgccggcaacgccgccagcatcccctccaagtgcggggtcagcatcccctacaccattagcaccttcaccgactgcttcagggtgaactaaaacctatacca

SEQ ID NO: 82505 - DNA, 273 bp, Zea mays
  Clone ID: LIB3114-032-P1-K1-E5
aaaaaaaaaaaaaaaaaaaaaaaaaaaaaaaaaaaaaaaaaaaaaaaaaaaaaaaaaaaagagaccattagaaaaatatgcaaacttacctcctccttcttactccctcattcctcttttttaatctcacctaatttcaattcactttccttaattttacaacttccctactttaaaaaccctatctttacccaacttaatcacctttcaaaactttcccttttcaccattaccctttatagataatactctctttacttatctcccttccca

SEQ ID NO: 82506 - DNA, 229 bp, Zea mays
  Clone ID: LIB3114-032-P1-K1-E7
ataaaaaaaaaaacaatataaaaaaatccaaacttacatacaacaaacatgcgacatcaggaggtctggtgtttctgacctaaatccacttcactcccctccttctatctttttacttggtcaccaaaaccctatccttcccatctttttcacctcattctacttttgaatacccccagctttcccatacttatcttctctcaacctttctccttttcccaaatttgct

SEQ ID NO: 82507 - DNA, 331 bp, Zea mays
  unsure at all n locations
  Clone ID: LIB3114-032-P1-K1-E8
tgtacgcctgcagtaccggtccggagtgcccgggtcgagccacgcgtccgactgcctttagctaagattttccataacttggtctcgagcacctatgtgttgcatgtgggctacgggcaaacttatatctgatttantttagattgcgatgaaaaaaaaaaaaaaaaaaaaaaaaaaccctaaaaatacaaaaaattaaacaacttataaaacaatacaaaattcaacaagtttcaaaaataactaagaggcccccaccaatcggccttaccaacaattgcacaaccatgaattgcaaataaggacgggccctggatcaaaagattaaaca

SEQ ID NO: 82508 - DNA, 74 bp, Zea mays
  Clone ID: LIB3114-032-P1-K1-F2
gtctagaggatccaaggttacctaccccttcggggcacctcggggctcgggtataggggcacctaaattcaatt

SEQ ID NO: 82509 - DNA, 296 bp, Zea mays
  Clone ID: LIB3114-032-P1-K1-F4
gaataaaaaaaaaaaaaaaaaaaaaaaaaaaaaaaaaaaaaaaaaaaaaaaaaaaaaaaagaaaaaaaaaagaaataaggtaaaaagggggcccttttttaaattacctaccttactttctctaccatccaaaatcataattctcttatattgccacataaatttaatccactggccatttttttataaccctcttacttgaaaaaccatatttttccccaaattaatctttcttaaacaaatccaactttaaccaactatggtaataacaaattttccccaacctaacccccttc

SEQ ID NO: 82510 - DNA, 138 bp, Zea mays
  Clone ID: LIB3114-032-P1-K1-F6
gttttatgtaatttgggccttgagatgtttctgaaccaaacagctaaaagagttcacgtgcgttttggggcaaagggtataatgtgatataaaatcacctaaattcaactaacttttaccaacatttacaccgtaaaa

SEQ ID NO: 82511 - DNA, 53 bp, Zea mays
  Clone ID: LIB3114-032-P1-K1-G1
ataattataatgccactccccctctacctgctcattaatctcgcattctgtat

SEQ ID NO: 82512 - DNA, 323 bp, Zea mays
  Clone ID: LIB3114-032-P1-K1-G2
aaaaaaaaaaaaaaaaaaaaaaaaaaaaaaaaaaaaaaaaaaaaaaaaaaacaaaattacggacaccttcatgataaaaaaattaacgttctcttgcttcccccttatataaattttcttttcctccatttacaaccaatttactttctaatacccttacatttaccccaccttataatacttctatcccttaccctttttaaccttccttactttattaacctatttccccctacctaaccttctttccataaaaacccccaccccttcttccttttctttaaatcacccccttctttaccttcttatttcccaccccccct

SEQ ID NO: 82513 - DNA, 298 bp, Zea mays
  Clone ID: LIB3114-032-P1-K1-H11
caccccccactctgaagctctggaagaggaagggggtctgggaagaagacgcggcgtacaagcgacaagggttacccgcatccgaccatcctctgcggatcgagtgggcaaagcgaagccgttgccgaccaacagacgatactctcgtgggcatgccacgccgttgcgctggctttattgcatggtggcgttgctcgctgtaatggttgtaaataaagaaggaaaatgtctcgggttttatatataatatactagcttgacatttctcgtctggcgaattgccggactgttcagaatg

SEQ ID NO: 82514 - DNA, 530 bp, Zea mays
  Clone ID: LIB3114-032-P1-K1-H4
acgcctgcatgtaccgttcctgatttcccgggtcgacccatcgcgtccgaaaaaaaaaaaaaaaaaaaaaaaaaaaaaaaaaaaaaaaaataaaaaataaaaaaataagggaaaaataaatgcatagtgcatctatattatttatactctcctaatttaactcttgcccccccctcttttagtcccttatttcccttccctttctttcccttcctttttttttttttttttccccctttattaatttccttgtccgccatattaccaccttcttccttttaaaccccttgttttacctactttttttcctttttaaccacatccccttttcccccctttctccattaatcacatgcccctgccctgtgttccctcaccataaccgcctccccttttcttcgcctttatccccccccccttttgcttttcttttatccctttctggttcttttttttcccctttttctctcccattctatttttccttttctctataccccccgttctttttatttttttccctttttttt

SEQ ID NO: 82515 - DNA, 145 bp, Zea mays
  unsure at all n locations
  Clone ID: LIB3114-033-P1-K1-A11
cccccccccctttttttttttttttttttttttgtttttttntctcaagggggaccaagccacataatcatatcatgtaattgcttgctttattcaccgggtactcaataatctctcttgctctctaaaattggtggattgttat

SEQ ID NO: 82516 - DNA, 229 bp, Zea mays
  Clone ID: LIB3114-033-P1-K1-A12
acaaaaaaaatttattaaaaaaaacaatataaataataaaaaaaaaacaaacgaaaaccgagccacataaataatataagttcatccacttctttattttcccaccttacatcctcattcttcctccctctttcttcttttattttttcccttaaaaacaataaaactccctccttttttccccctcttttctataaaacccttttcctttcccctcttactcactttt

SEQ ID NO: 82517 - DNA, 170 bp, Zea mays
  Clone ID: LIB3114-033-P1-K1-A2
aaaaaaaaaaaaaaaaaaaaaaaaaaaaaaaaaaaaaacaaaaaataaaaaaaaaaaaaaagtaaaaaacggggggctgccgatataataaaatccaatctaacttacccttacttccaactacataccttttttatacaaccacctaaattcaataaactgtcccttta

SEQ ID NO: 82518 - DNA, 269 bp, Zea mays
  Clone ID: LIB3114-033-P1-K1-A4
cacacaaaaggtgggggatggataggattatagatggatggtgacacaacacagcagggcacatggctagcctgctagcgtgcggcacccacacaacacaacacactgctcgccagaagcgccccaggaggccaggggaggacacgacgccgccatcagccatcatcatcatctcagactcagagcatgccatggcacgcaactgactgactgactcgaaacacacacagcgacgccgctatactttattaagctttataattagctag

SEQ ID NO: 82519 - DNA, 441 bp, Zea mays
  unsure at all n locations
  Clone ID: LIB3114-033-P1-K1-A8
cggaattcccggctcgacccactcgtcctaaaaaaaaaaaaaaaaaaaaaaaaaaaaaaaaattaaaaaaaaaaaaaaaaaaaaaaaaaggaaaaactatataaaaaaaaacaaacttacaaacacatacatacaaacatcatacctcttctttaatgccacctaatttcatttccctgcccttatttttacaacatttatcctggtaaacccctctctttacccaactaaatatccttgcaccacatccctttttctccattttttttaatacccaaaaggcccccacccttcgcccttccaaacaatttcccatccttaatacccattgttactctccctttattcgcccattaacccctccccttttggcgctttcccgcaatgtgacaggtacacttcccaangccctaccacccaatcctttcactttttttcctt

SEQ ID NO: 82520 - DNA, 219 bp, Zea mays
  Clone ID: LIB3114-033-P1-K1-B10
aaaaaaaaaaaaaaaaaaaaaaaaaaaaaaaaaaaaaaaaaaaaaaaaaagagagaaaaaagaaaaaaaggaaataagggaaaaaaaaataacacattcccattcatttctcaccatttctttttctttttttacactttcttaattttttctgtcttttttttaaatttattcctctgggcccaactttcactgtttctaatctttatcctccctttt

SEQ ID NO: 82521 - DNA, 55 bp, Zea mays
  Clone ID: LIB3114-033-P1-K1-B12
aaaaaaaaatatacaaaacaataataaaataaatcataactcaaataacggcaaa

SEQ ID NO: 82522 - DNA, 187 bp, Zea mays
  Clone ID: LIB3114-033-P1-K1-B4
aaaaaaaaaaaaaaaaaaaaaaaaaaaaaaaaaaaaaaaaaaaaaataaaaaaaaaaaaatgcggacaggcgaaaaaaaaaaaaacttacctactcatccataccaaccaaataactttttttttttttttaaattaaattacaattcatttttcctgcccctcacaatattacccactggtaaaac

SEQ ID NO: 82523 - DNA, 447 bp, Zea mays
  unsure at all n locations
  Clone ID: LIB3114-033-P1-K1-B6
tacgcctgcagtacccctccggaattcccnngtcgacccactcgtccggccacactttctaactagttctacatctctagcggcccctctataacatccaagctcacgcacccttggatgccacctattatgtcatctatattcacacctatatccaattcactacaccgcctttaataacaaaaccactttcgatacccaacttaatacccttctaacacatcttcctttacacacctctcttaatatctaacatgccagcacctatcccccttcccaacattttcacaaacttaatctcaaattgaactccccctgtaactccccattaatctccgcatttatattttttactctcatctttaccattacacttaccaacaccctaactccccctcctttccttttttttccttcctttttttccaactttctcccatttttccc

SEQ ID NO: 82524 - DNA, 93 bp, Zea mays
  Clone ID: LIB3114-033-P1-K1-C10
tggtacgcctgcacctacctactccagaattcccggggcgagcgcacgcgtccgcccacgcgtccgcccacgcgtccgctagaactagtggac

SEQ ID NO: 82525 - DNA, 166 bp, Zea mays
  Clone ID: LIB3114-033-P1-K1-C5
gaaaaaaaaaaaactaaattttaaaccacaaacaaccactctaaaagataaaaaaaaaaagggaaaagggggggctgcctatttgggggatccaatcttacctacccctccatacaacccaatatttcttctatataaacacctaaattaaattcactaaccggaa

SEQ ID NO: 82526 - DNA, 201 bp, Zea mays
  Clone ID: LIB3114-033-P1-K1-C8
taaaaaaaaaaaaaaaaaaaaaaaaaaaaaaaaaaaaaaaaaaaaataaaaggaaaaaaaaggtcacatataaaaaaagtgaaacaaactaacacttcctatacaaccccctctttttactttccctcctcctaatttccatctccttgcctttaatttacctctttttaacccaaaaaaacccttcttttacccaatttt

SEQ ID NO: 82527 - DNA, 400 bp, Zea mays
  Clone ID: LIB3114-033-P1-K1-C9
aaaaaaaaaaaaaaaaaaaaaaaaaaaaaaaaaaaaaaaaaaaaaaaaaggaaaaaaaaaggaaaaaaaaaaaaaagggggcgccccctttttaggatccaaactttcctcccccttcattccacataatatcttttttttattgtcccctaaattcaattcactcgccccctttttacaccaccttgactttgaaaaccctttcgtttcccaactttttctcctttcagaacatacccctttttccccttttcgtaataaagaaaaggcccccacccatttccctttccaacattttcccaccctcaatgtggaatttgaccccccctttatcccctcatttaaccctccgggtgtggtgtttacacccacagtgacccctatactttcccatgcccta

SEQ ID NO: 82528 - DNA, 70 bp, Zea mays
  Clone ID: LIB3114-033-P1-K1-D12
actctgaagatccaacttactgcgcatcgggcaacgggtaactcttctataatctcacctaaattcaatt

SEQ ID NO: 82529 - DNA, 163 bp, Zea mays
  Clone ID: LIB3114-033-P1-K1-D2
ctttctatataatccaatcttacatactcgtacgtgctacttcgtagctgttctatagggggacctatattcaattcacttaccttctttttacaacttaattacttgtaaaaccctttctttactcaacttaatctcctttcattacattctcctttctcca

SEQ ID NO: 82530 - DNA, 400 bp, Zea mays
  Clone ID: LIB3114-033-P1-K1-D3
aaaaaaaaaaaaaaaaaaaaaaaaaaaaaaaaaaaaaaaaaaaaaaaaaaaaaaaaaaaaaggaaaaaggggcaaacaaaaaaaaggcaacaaaaaaaaaaatatcccacttttactttctccccttttttaacttcccattttccccccccttcctttccctaccttctctttttttttatttcccccacataaatttccttccccccctttttccaccccctttcttggaaaacccctttccccccccaccttatccccctttccccccatccccctttttcctattggctttttaccaaaattgccccgcccattttccctttccaaattttgcccaacctcacctcttaatttgccccctccttaacccccccttttaccgccccctgcttttttt

SEQ ID NO: 82531 - DNA, 335 bp, Zea mays
  Clone ID: LIB3114-033-P1-K1-D5
aaaaaaaaaaaaaaaaaaaaaaaaaaaaaaaaaaaaaaaaaaaaaaaaaaaaaaaaaaaaagggaaaagggcaaacaataataaaataggccaaacttacatacacatacatacaaaaaaaaaaactgtggcatccttttaaaataaatcaaatttacttcccctttttttccaactattattttttttataacccccccaaaaccaaattcattgcccttggtttaaaaaccccctttattgaaaaaaccttttttttaccaaattaaatccctttgaccatatccccttttccccatcttgaataataaaaaaaaggcccccaccaatcccct

SEQ ID NO: 82532 - DNA, 130 bp, Zea mays
  Clone ID: LIB3114-033-P1-K1-D6
aaaaaaaaaaaaaaaaaaaaaaaaaaaaaaaaaaaaaaaaaaaaggcaaacaatataaaagggaccaagcggacaaacgcgtacaatgcaacatcataactacttatataatataacctaatttcacttt

SEQ ID NO: 82533 - DNA, 364 bp, Zea mays
  Clone ID: LIB3114-033-P1-K1-D8
taaaaaaaaaaaaaaaaaaaaaaaaaaaaaaaaaaaaaaaaaaaaaaaaaaaaaaaaaacaggcaatataaaaaaaaccgggcttacaaacacatacatacaaacaaaaaaactcttaatttaaaaatcccctaatttcatttcactaaccaaatttttacaacgtggggccttttttaaccctctccttacccaatttattccccttccactattttctttttttttccaccccccaaaatacctaaccgccccccctttttcccccttcccaactttaaaacccctctaattcccccattttactccctctttgagcccctctcttttttccccctttttttttatttaaaaaaagcctaac

SEQ ID NO: 82534 - DNA, 403 bp, Zea mays
  unsure at all n locations
  Clone ID: LIB3114-033-P1-K1-E6
gctccgggattcccggggggagccacgcgggcgggtcaacctcaaccggggatcatgagaggccggcgtacccggcgagcgctcctagcggctagcgggancattggcggtgggctatcgggcgagatnaatctttgcctatgccaccngcggacgggtgggtggtcctgcaggctggggtcttggtttcgtgggcaggccatgtggcccatctccggtccttcagatgatctgggtcgcatctggcttggggatgggtttgatatggggtggttggggcatgccccatggaacaaccctatcgctatgctggtttggtgtgtacaatggatgacgtgtgctggcggtttggtgtgggtacaatggatatgtctgggtggtggataanaagaaattggtatat

SEQ ID NO: 82535 - DNA, 74 bp, Zea mays
  Clone ID: LIB3114-033-P1-K1-F10
tctagaggatccaaccttacctacgcatgcgggcggacgtcatatctggtctataaaatcacctaaattcaatt

SEQ ID NO: 82536 - DNA, 216 bp, Zea mays
  Clone ID: LIB3114-033-P1-K1-F2
atgcatatttcctggtacttgtgaaatgcctgcgtctaggcagctcatcaaatatcaggtgtttcccagaaaaaaaaaaaaaaagaaaaaaaaaaaaaaaaaaaaaaaaaaaaaaaaaaaaaaaaaaaaaaaaaaaaaaaaaaaaaaaaaaaaaaaaaaagaaaacctttaaaaaaaaaaaaaaataaaaaaaattaaaaaaaaaactaaaaattt

SEQ ID NO: 82537 - DNA, 352 bp, Zea mays
  unsure at all n locations
  Clone ID: LIB3114-033-P1-K1-F3
tactcctgcaggtacccctccggaattccctngtcgacccactcgtccgaaaaaaaaaaaaacaaaaattaccaaaaaaaaaaaaaaaaaaaaaataaaaaaaaaaaaagggaaaaattggaaaaaaaaaaaaaaagagaaaaaaaaaaaaacaaaaaatttcctccttttaataaattccaaggtcactttcccgtacctccacctttttaccccttttataatagactactaattttcttcaataacatcacttaacaccacttttccctttaaaccatctttagaaaaccttctttattccccaaataaccaaacaaaatatccacgactgacttgtcattcaaacatc

SEQ ID NO: 82538 - DNA, 426 bp, Zea mays
  Clone ID: LIB3114-033-P1-K1-F5
aaataaaaaaaaaaaaaaaaaaaaaaaataaaaaaaaaaaaaaaaaaaaaaaaaaataaaagagaaaaaaggaaaaaagggaatacggtcttctaaaatccaattttcctcccctttttatttcccatttttacactcccttttttcttaccttaacctttttttatcgccttacttaatttaaatttattgccctttattctactaccttaccactcaaaaaccctttcccttaccaacctttttccccttttaacatattctctttcaccccctttcctttttccttaaaaaccccttacccattctttttccaaaaatttccccaccctttttccatattttatacccccttttattctccttttaacccctcttttcttctttctttcgcacttttttcccctttttttttttatttttttt

SEQ ID NO: 82539 - DNA, 316 bp, Zea mays
  Clone ID: LIB3114-033-P1-K1-F8
gactagttcttgattgcataaaaaaaaaaaaaaaaaaaaaaaaaaaaaaaaaaaaaaaagaaaaaaaaaaaaaggcggccaatctaaaaaaatccaaacttacatacacatacatacaaaaaaaataactattatataaaaaaaacctaaattcggcttcactttttcaaggttccacattttcttccccttgaaaaacccttaattttccttttttaatccccttaaatcacatcccccttcccccatttaacaaaatagcaattaggaaacccccggtctcccctaccaaaatttcctcaaacaaaatcccctt

SEQ ID NO: 82540 - DNA, 355 bp, Zea mays
  Clone ID: LIB3114-033-P1-K1-G10
ctccagttccccttcaccactccccatctacccactcctacccactcttcctaaatacacaaacaacaccatcaaaaaaatccaaaacattacatacacaatacatgcaaaatggtaaacttttcttctctctcccataacatccaaccacttctaccccattctatattaaacccacctacccttccatcctttccaatcttatatccattcccctatggaccatacaactcaacttcctttctccaccttttacaactccaaccccctcaaatccccctcttacccaccttaaaacgcctttccacccttccccctttccccaactaacaaacttaccaacccacccccccct

SEQ ID NO: 82541 - DNA, 339 bp, Zea mays
  unsure at all n locations
  Clone ID: LIB3114-033-P1-K1-G12
tacaaaaaaacaacctataatattttaataaaaaatacccatcctactgggggattaaagaaaaatagctaaatgtgtccatannttttctgctttttccttgttacttatcccccactatctttcccttttcttccagctacacctttatataaaaggaatacctctatttactcgatatctacatataaacaactgattcactaaacaaacaataaaattctcgtctaaactatttgaataaaaccatgaattttctccgccctctatatgatccaacattacatcccctttcatgctaccaaataaattttctatattgttacctaaattcaattc

SEQ ID NO: 82542 - DNA, 396 bp, Zea mays
  unsure at all n locations
  Clone ID: LIB3114-033-P1-K1-G6
ccactacatacaaaaaaaaaaacaaccaatctaaaaaaatccaaacttacatacacatacaggcgacatcggaactcttgtataatgtgacctaaattcaattcactcccctttnttttacaacnttttcactcgcaaaaccctagctttacccatcttaattgtcttccatcacatccctctttcgccacctggcttaataccgaataaccccaaacccatctcccttcccaacattttctcattctaaatagataatcttaccctccctttagcttatcattaacctccccccctctttttgcttctcccagctttacccctacacttattcacaatcctaccccccccttctttctctattttcccctcctttctttgcattttcccccactt

SEQ ID NO: 82543 - DNA, 189 bp, Zea mays
  unsure at all n locations
  Clone ID: LIB3114-033-P1-K1-H1
agagcggatcggcgcggcccgggccgccgtggccagcagcagcagcagcagcaggtaggtggggggaggcggcgccgctagctaccgcaatananaaccctctctctctctgtggttgtaagtagagtagcctgttgctggcctcttccacttagtatagaggtcaaacctctctccatgcacgacana

SEQ ID NO: 82544 - DNA, 323 bp, Zea mays
  Clone ID: LIB3114-033-P1-K1-H12
tacgcctgcggtcccctgccggacttcccgcggtcgagccgggtggacccacgcgtccgactaccctctttgtgtgctgccatccatccgtccccgctagaccatcgaggagagaatggcgcagagctctgtgctcccggcctctgtcttctgccgtcccggccgtttaatttatagtctctactgtgtgttcgtcccatgtgtttagcagcagcagcaggtgtattgtgcgggtatgtaatggtattgcaactatattgggtgtaaaaccataataaatgtggaaaaaatgcaaggaaaaaaggcttctactgtttacactt

SEQ ID NO: 82545 - DNA, 410 bp, Zea mays
  Clone ID: LIB3114-033-P1-K1-H2
aggaatccgatccatccaagccaagccaaggcagagaagaagaagaggaggaagaagaagcatcggcagcatgtcggaggggactgccaactgcgtggacatcctgatcgccatcatcctgcctccgcgtgggggtgttcctcaagtacgggtgcggccacgagttctggatctgcctcctcctcaccttcctcggctacatccccggcatcatctacgccatctacgccatcaccaagaacacctagctaggcatccttgccgacgacgatccatgtctctggatctgtgtctggtcatatgcctgatgccgacttgtgctgtatgtagttgcttgaattcagtcgtgttcctggtttggtaccggacccaccccatgcatcatctgtcaccgcgacgcaataatcata

SEQ ID NO: 82546 - DNA, 192 bp, Zea mays
  Clone ID: LIB3114-033-P1-K1-H3
aaaaaaaaaaaaaataaaaaaaaaaaacaaaaaaaaaaaaaaaaaaaaaaaaaaaaaaaagggcgtaaagaggaaaaaagaaaaaacataacaactcctcccccattcttttctccatcatccttcctcctccttgcttcctcctaattttcttttttttccacctaatttaatatatttctccttcttatt

SEQ ID NO: 82547 - DNA, 53 bp, Zea mays
  Clone ID: LIB3114-033-P1-K1-H7
aaaaaaaaataaaaaaaaaaaaaaaaaaaaaaaaaaaaaatcaaccattatgg

SEQ ID NO: 82548 - DNA, 401 bp, Zea mays
  Clone ID: LIB3114-033-P1-K1-H9
aaaaaaaaaaaaaaaaaaaaaaaaaaaaaaaaaaaaaaaaaaaaaaaaaagggaaaaaaggagaaaaatcccatacgggaaaacccaacttactttctctttcttacccttcccttatttttctctcctgcccctaattctctttatcttcactctatttcacttccattccctttcaatcccttctctttcccatctttttcatcttccttcactttcccattttaccccctttcgctatttccccaattcccccacttctcctcctttctaacaattccccccctctccttctcttttatttctcccgctttttctatttctttatccgctccccctttttcttttttactttcaaccccccccgctaccctttccttccccttttttccccttttttt

SEQ ID NO: 82549 - DNA, 247 bp, Zea mays
  Clone ID: LIB3114-034-P1-K1-A1
ctcggaacaatgatgatgacgaaataggccgtgttttcttggacaatgatgttaagttcggcaaggttttcctttctctttttttattctactgcgtggtctatgtgtatattgccaaaggcatgcgtgagccatgcgcccggtgctggggcgcagagaccatctgatggtggaaacaccggaaataagagcgtgccgctgtgtgtttcctttgaaggaataaaaatggtgttcgtgttgtgcaaaa

SEQ ID NO: 82550 - DNA, 69 bp, Zea mays
  Clone ID: LIB3114-034-P1-K1-A3
caaaaaaaaaaaaaaaaaaaaaaaaaaaaaaaaaaaaaaaaaaaacaaaaaaaaaaaaaaaaagaaagg

SEQ ID NO: 82551 - DNA, 425 bp, Zea mays
  Clone ID: LIB3114-034-P1-K1-A6
cttaaaaaaaaaaaaaaaaaaaaaaaaaaaaaaaaaaaaaaaaaaaaaaaaaaaaaaaaaagggaagggtaaaaaaaaaaataggggaaggaaaaaaaaaaaaaaaaaaaaataaaataaaaaataaataaaaaaaagggggccccccttttttaaggttccaattttacttccccttccttccaacttattacttttttttttgtgccccctaaattaatttccttgcccccctttttccacccttttacttggaaaacccttggctttccccaatttattccctttgcaaaacttccccttttccccagttggcttaataccaaaaaggcccccccctttccccttttccaacatttgcccccccttaattgcaatttgcccccccccttttcccccctttaacccccggggttttttttttt

SEQ ID NO: 82552 - DNA, 167 bp, Zea mays
  Clone ID: LIB3114-034-P1-K1-A7
aaaaaaaaaaaaaaaaaaaaaaaaaaaaaaaaaaaaaaaaaaaaaaaaaaaaaaagggaagagggaaaaaaaaaaaagggaaaggggccccccctttaaaggatccaagcttacctacccgtgcatgccaaggggtggcctttttaaaggggcaaccaaatttaact

SEQ ID NO: 82553 - DNA, 386 bp, Zea mays
  Clone ID: LIB3114-034-P1-K1-A8
aaaaaaaaaaataaaaaaaaaaaaaaaaaaataaaaaaaaaaaaaaaaaaaaaaagggagggggttaaaaaaaaaggggagaaggggccaattaatttaatattttcaacttttcctttcttctcccctaatatcatttcttttcttttttttttccttaattcttattgcaaaccctttgtttctctttattttttttaacttttctccttttcttcctaatttatattttcttaatatttttctcccttccccattttcccccttcccatattttccccattttatttgcccatccccccctcttcccttatccttaattttttaactccccccctccctctttttttccccctccttctcttttaccccttttttttttttcc

SEQ ID NO: 82554 - DNA, 68 bp, Zea mays
  Clone ID: LIB3114-034-P1-K1-B12
atgattcatgtttacttacgcgggcaggcgacgtcatagctgtggtatagcgacacctaaattcaatt

SEQ ID NO: 82555 - DNA, 178 bp, Zea mays
  Clone ID: LIB3114-034-P1-K1-B4
aaataaaaataaaaaaaaaaacaaacaatataaaaaaaaacaaaattacatacacaatacatgcgggggcataccatcttgtatgggcgctacctacattcacttcactgccccgcgttttacatcttatagactgcgaaaaccctggccactcccaacttaatctaaatccaggaca

SEQ ID NO: 82556 - DNA, 124 bp, Zea mays
  Clone ID: LIB3114-034-P1-K1-B5
tggaggatccaatcttagggacgcgttcatgcgagggggtaggctattctataaggtcacctataatgaatctacatggccgttgatttacaacgtttttactgggaaaacactggggaaaccc

SEQ ID NO: 82557 - DNA, 292 bp, Zea mays
  Clone ID: LIB3114-034-P1-K1-B7
aaaaaaaaaaaaaaaaaaaaaaaaaaaaaaaaaaaaaaaaaaaaaataaaaaaaaagggaagggaaaaaaataaaaaagggtataaaaaaaaaaaaaaaaaaatataaaaaaacataaaaaaaaaaggggggggcctttttaaaggtccaaacttaccttccctttctttccaacaaaaaattttttttttagggcccccaaattaaaattaattgccccctttttaaaaccctttaacattggaaaaaccttgtgtaacccaaattaaattccctttaaaaaaatcccctt

SEQ ID NO: 82558 - DNA, 92 bp, Zea mays
  Clone ID: LIB3114-034-P1-K1-B8
ctctatcgctagcgggcgatctagaggattcaagcttacatactcacgcatgcgagggtgtaactttattattgtggtatctaaatacaaaa

SEQ ID NO: 82559 - DNA, 345 bp, Zea mays
  Clone ID: LIB3114-034-P1-K1-C11
ctctgtctctctattggcgacgactgggctaccgccgccacaggcgccctacgccaggtgtccaggtctcgggcccttctccggcaccgagcacccaccagcggaatataccatggaggtcaggcccatggtagctctgcgtgccgccctagttggtggggtagcggcatttgcgaagatcggtggggcgatgaaagccgcaggcggtgtcaagattggtgcagccgctgcagccgtcacggctgcaacatcagctgccatatcgggaaaagacgcaaaagaagacacttcaaagccggaaacgaaatgatatgacccatggattggtcgacaagtatgaaatcg

SEQ ID NO: 82560 - DNA, 149 bp, Zea mays
  Clone ID: LIB3114-034-P1-K1-C12
cccaggcatagctgggtaccttttaacttctgtttgtgggatttgctagagtgatgggtgcgatatatagggggacttgaatgtctggaatgctacggtataacgcacatttgggtgcaatgtctgttgcattgctgtctgaatgaaaa

SEQ ID NO: 82561 - DNA, 119 bp, Zea mays
  Clone ID: LIB3114-034-P1-K1-C5
cacgccggcaccgtcccgaaattcctttgtcgagccacgcgtccgaaataaaaataaataaaaaaaaaaacaatataaaataatcaaaactaaaaaacacttaacacgcggggtcaaaa

SEQ ID NO: 82562 - DNA, 154 bp, Zea mays
  Clone ID: LIB3114-034-P1-K1-C6
aaaaaaaaaaaaaaaaaaaaaaaaaaaaaaaaaaaaaaaaaaaaaaaaaaaaaaaaaaaaaagaggaggaaaacccacgggtgtgggggaaccaaacttccctcccctttcttgcaccctactaccttttttattgtgtcacctaaatttactt

SEQ ID NO: 82563 - DNA, 444 bp, Zea mays
  Clone ID: LIB3114-034-P1-K1-C9
aaataaaaaaaaaaaaaaaaaaaaaaaaaaaaaaaaaaaaaaaaaaaaaaaaaaagagaagggaaaatataaaaagggggggcatatacaaaacttaaaacctattacccttcccctatctctttttacttttgttcttttttgtttcctctttttactctttttttttttcttccttttcctttttctattctcttcttattttttttccctttatttccatccctttttccttttttctactattctccctttcgtattccccatccttttcccccccttttattttctttttaaccctctcctctttttttctattttctctttatttcttcctttttctctatccctattttttctttccccctttttttacttttctaatcccctctcctttctccccctcttctatcccctccttttctccttttcttctctcttttt

SEQ ID NO: 82564 - DNA, 131 bp, Zea mays
  Clone ID: LIB3114-034-P1-K1-D12
caagatgtaccagggcgcggttcaagacgtggggggcgctggcggcatggaccaggactcccctgccggcagcggcggccctggccccaagatcgaggaggtggactaagcggttgttgtcagtcttgagt

SEQ ID NO: 82565 - DNA, 332 bp, Zea mays
  Clone ID: LIB3114-034-P1-K1-D2
accattgtggactggtacaatgatgctgtcgcagctgggaaggactcccaggttgtcaagaatgccaagccgttcgtcgagtggctccagagtgccgagtctgatgaagagggtgacgacgagtgaagaggccacgctgctctactgctaatggccgaacttgataatattatttcaataagtttgttttgcttgcctggtgtcggtgtttaaaactgttaattgtcgtgtggcgcagcatactcttctgttgctgcatgtgtcgtcgtcagtttggttgtctgttggatgtcacagtttattatggattgctactatacaagtatttgttt

SEQ ID NO: 82566 - DNA, 329 bp, Zea mays
  unsure at all n locations
  Clone ID: LIB3114-034-P1-K1-D3
aacataaaaaactgatacaaaaaaaactaacacaacaaaaaaaagactcccaaattaacaggaatggcgaagccattcgtcgagtggctccacacctccaattcttatcaagagcgggncnactagagaagaggccacgctgatctactgctaatggccgaacttgataatattatttcaatccctttcttcagcttgcctggagtcggtatataaaactgctaattgtcctttcgcacagcatactctcctgatgctgcatgtgtcgccctcagtttcgttgcctgttgcatgtcacactttattatggctcgctactatacaagtat

SEQ ID NO: 82567 - DNA, 85 bp, Zea mays
  Clone ID: LIB3114-034-P1-K1-D6
cggaattccatgttcgggtcgagcgacgcgtaccgacatagtctagatcgcgagctgacggtctagaggatccaaggttacgttc

SEQ ID NO: 82568 - DNA, 414 bp, Zea mays
  Clone ID: LIB3114-034-P1-K1-D7
cgtcaaacttcggaggtttgccttctacctgagaccgggagggctttcagacgtgaggcgctcggttacattggactatacagtgggaacatccaatacatgctgctcggcaacgttggtgaatctgacaacggattgatccagtttgcaacgggatgcaccaacctgcggaagctcgagctgaggggctgctgcttcagcgagcgagctctggcagtggccgtgctccagatgccctcgctgaggtacatatgggtgcaggggtacagagcctctcgaacgggccaggacctcatgctcatggccaggccgtactggaacattgaattcgcgcctcccattcccgagagcgcttatcgggtgatggcagatggacagccttgtgttgacacccatgcccaggtccttgcgtat

SEQ ID NO: 82569 - DNA, 174 bp, Zea mays
  Clone ID: LIB3114-034-P1-K1-E2
aaaaaaaaaaaaaaaaaaaaaaaaaaaaaaaaaaaaaaaaaaaaaaaaaaaaaacaaacagaggaagggaaaaaaaactggtgtgcggtaacctacccccacttcactttcctgtccctttttttttacccctctttctaacccatatcttttcccatcctaacttaataacct

SEQ ID NO: 82570 - DNA, 418 bp, Zea mays
  Clone ID: LIB3114-034-P1-K1-E3
catggagtagatagcctacggaagaaacaaaacgtttctctatctggatatctacacgggtggtcttccgagacctcagcgcctgaccttccatattctttgagcatgctactcgatcttgtcgctgatgagaatggttccgttgtccttggcgtggctggaaaaagctacagggacatgctcatgagttgggcatgccgcctgcgtcgtcttagagttaccaatttcttagtatgtgccttagaccatgagacatatgagttctcaatcttacaggggttgccagttttcagagacccattgtcaccaacaaatgtcagctttgacgactgccactttggaacgaagtgttttcaacaagtgacaaaagtgaagtcgcggattgtccttgagatactaagactgggatacaatgtgc

SEQ ID NO: 82571 - DNA, 416 bp, Zea mays
  Clone ID: LIB3114-034-P1-K1-E9
gcactccattgggctgcattttgtggcagagagcgaacagttgttgcacttatcgcacttggtgcggctcctggagctttgacagacccaacgccaattttccctacaggaagcacaccagctgatctggcatcagctaatggatacaaggggatctctggtttcttggccgagtcttctttaacaagtcatcttcagaccctcgatcttaaggaaggcaaggggagcaatccgccagaaatatccggtctgcctggtattggagatgttactgaaagaagagcatcaccattagcaggtgaaggtcttcaagctggatccatgggagattcactaggtgctattcgaaatgctgcccaagctgccgctcgtatatatcaagttttcagggtgcagtctttccagagaaagcaagc

SEQ ID NO: 82572 - DNA, 334 bp, Zea mays
  Clone ID: LIB3114-034-P1-K1-F8
aaataaaaaaaaacaaaaaataacaaaatataaaaaaaaaaaaaaaaaaaaaaggggacggggaactacaaaaggcaggcggaaataacagctactcctccaaacagcggcgccgcctcttttagggtgcccaaatttatacccccacccgtctgaccacttaaccaccatataccagcccctaattttaatccacctgaccatccatttacacacgcctagcccggtaaaaaccgtggcctaacccagactaaccaatcttacaaacactttcattttacataattgcttttatatcgagaagcctcaatccaatgcaccttcccaccattta

SEQ ID NO: 82573 - DNA, 104 bp, Zea mays
  Clone ID: LIB3114-034-P1-K1-G2
aactaaaaataaaataaaaaacaaacactcgaaaaaaaaccaaacttacatacacaatacatgcgagcgtgataactcttatatagtgtcacctcaattcaatt

SEQ ID NO: 82574 - DNA, 152 bp, Zea mays
  Clone ID: LIB3114-034-P1-K1-G3
cctaataaaattaatatctaccaaacaatctaaaaaaatacaaccctactaactccatccttacaccgtgatcttttttatacagtgatccctacatataaattcacttctcataactcaacaaccaattttactaataaaacccattcatt

SEQ ID NO: 82575 - DNA, 53 bp, Zea mays
  Clone ID: LIB3114-034-P1-K1-G5
cactacaactagatttttttctttctctataaaaagatacaaacttacgggcg

SEQ ID NO: 82576 - DNA, 119 bp, Zea mays
  Clone ID: LIB3114-034-P1-K1-G6
aaaaaaaaaaaaaaaaaaaaaaaaaaaaaaaaaaaaaaaaaaaaataaaaaaataccaaactggcgtgggcgtacctgcggcgccgtacctcttctatcgagtcccctaatttcatttt

SEQ ID NO: 82577 - DNA, 382 bp, Zea mays
  Clone ID: LIB3114-034-P1-K1-G8
agacgcggttctgccagaagctccagaagagttggtttgtgagctggcctggcgatacattttcctgtttgaaacaatcacgaagacaaaattcgagatcctagaagcgcaggaaccaattcatgaaaggatatcaaggaatgtcgctcaagccttacgggacctatgattgctgatagaggatctggggcagagtttgagtgcatttctggaaccaattcatgaaaccatctgatagggttttgggtgcatttctggcactaatattcccgtgcgaatagcaagtagtctgcgcagatgccatatatccgtcctgtgagggttgccattgcgtcttgatgaagcagaactatccaccacatttcttcatgatctgtgatat

SEQ ID NO: 82578 - DNA, 292 bp, Zea mays
  Clone ID: LIB3114-034-P1-K1-H11
cctgcaggtccggtccgaattcccggggggcgcacgcgtccggagaaacccaggaacgccgagaagccgaccaagtacgccggcagccccaagagcgacggggcccgcgtgatccaccagcctcgctaggttcgctgggggaactcatcaggaaggctgctgcccctcttgcagccttgctcctggctgccgccgctgtcgtggtctgctctttcaagtcgaagtaacggtggttcgagctagtggatagtgtggctcaactgtagaagttccttttgtatagcaagcaagt

SEQ ID NO: 82579 - DNA, 269 bp, Zea mays
  Clone ID: LIB3114-034-P1-K1-H12
tttacgcctgcaggtaccggtccgcggttccggttgcggggggcgcgcacgcgtccggagaaacccatgaacgccgagaagccgaccaagtacgccggcagccccaaaagcggacagtgggggcgtgatccaccaggactcactattttctctccgggaactcatcaggaaagctgctgtctctgttgcacccaatttcctggctgtggccgctgtttacaaacttcttttttgggaaaaccctgcgggtgcccaagctaatgggttgg

SEQ ID NO: 82580 - DNA, 374 bp, Zea mays
  unsure at all n locations
  Clone ID: LIB3114-034-P1-K1-H2
ggacttgattcaggtgatggcgtctgctaaagaggcaatgaaagctgttgtagcagagaagctgggcctgtttggatcgtgtgggaaagcctgatcgaagtacttgcgttgcgccggcaacatgcagtacaagaccgactgcatcatcgggttcgtgatgctgctgctactgtgcagttgcttacagttacagctcattgcgttgaacagctgaagtggttatcgtactttgcagtgtagcgcaactaaggctaattcataaatcgtaataatgtatgtatgctgccccgctgtaaaaatgctccgtcgataataaatgccatcgcgcttgctgggcctttggttacatttttnaaaaaaaaaaataactttat

SEQ ID NO: 82581 - DNA, 265 bp, Zea mays
  Clone ID: LIB3114-034-P1-K1-H3
ccggtccggaattcccgggtcgaccgcgcgcgtccgggacttgattcaggtgatggcgtctgctaaagaggcaatgaaagctgttgtaccacacaggcggcgcctgtctggatcgggtgggaaagcctaatcaatatacttgcgtggcgccggcaacatgcagtccaagaccgactgcattatcgggaccgagatgctgctgttactgagcagttgcttacaggtacaggtcattgcgttgaacagctcgagtggttattgctct

SEQ ID NO: 82582 - DNA, 79 bp, Zea mays
  Clone ID: LIB3114-034-P1-K1-H6
gcccgacgactacgacgacggggaggtaggggacgaatcgttgcaagcaacgaggtcagaactaaggaggccgaatcca

SEQ ID NO: 82583 - DNA, 103 bp, Zea mays
  Clone ID: LIB3114-035-P1-K1-A10
gactaaatataaaatacacgagcggccgctctaaaaagatccaagcttacatacccgtgcatgggacctcataagtgttgtttagtgtcccctaaatttaatt

SEQ ID NO: 82584 - DNA, 183 bp, Zea mays
  Clone ID: LIB3114-035-P1-K1-A11
tctttcttttcttttctgtttaattatttttgttgttctggttggcgccgccgtggatcggagggatccccaagccgaaggatgagcttggctggcgcatcgaagcgcatgcaacggatgtgtgcggctttggttctgtaataagacaaccaggggtccttttttcgatctgttattagcggc

SEQ ID NO: 82585 - DNA, 170 bp, Zea mays
  Clone ID: LIB3114-035-P1-K1-A12
taataaaaaaataaaaaaaaaaaaaaaaaaaaaaaaaaaaaaaaaaaaaaaaaaaggggaagggaaaaaagaggaagagggaaaaataaactttgattgacacatcgtaactcttccatcgcctcttttctgcttttcttctgtctttaaacacccagcgtttctttttt

SEQ ID NO: 82586 - DNA, 321 bp, Zea mays
  Clone ID: LIB3114-035-P1-K1-A2
ctgcaggtccggtccgaattcccggtggcgcgggcgtccgcgattacgcatatatagtacacaagaaggcagtttgaggataaattttggttgctcaaatgtgccggagtttttatttgacgaccaaaagatgaggctatgtactagggtgccgaggaatactagatgctgtagggccgaaatgattttatcggtagtttctgattgctcattgctgtaaggcagctttatattggtgtaagttactcgcctcaaaggcgttattcaggatctagaaacgctttgttgtgctgaaaaaaaacaaaaacctgcaagcacatt

SEQ ID NO: 82587 - DNA, 104 bp, Zea mays
  Clone ID: LIB3114-035-P1-K1-A6
cggacgcgtgggaaaaaaagcagacaaaaataaaagaaccaagcttacataacacatacatgcgaggggggtaaatcttctatagggtcgctctaaattcaatt

SEQ ID NO: 82588 - DNA, 386 bp, Zea mays
  Clone ID: LIB3114-035-P1-K1-A8
caatggcaaaactatctacctgtagcaacgaaagaaacgaggcacgatgacgtgttctagtatattcagatatgccacatgacacagagggtgatgacagcgcataagtgaactcaacaagcaagagatatcgtcaccaccaaaatggtgtttgctttttgcgcacctatcaggagcaccatcacttttggatcatgaatgctttcctatagatatgaacctactgttatactatttgtggatatgtacatattgacttaacacctgcaagcacattgttgctaagtgttgatgtatggtagttgaatgctacttagtatgtattgtagtctaaatccactctacagctggtatcaactattatataaaaacaacgtcatatgctt

SEQ ID NO: 82589 - DNA, 64 bp, Zea mays
  Clone ID: LIB3114-035-P1-K1-B1
gtccggaattcccgggtcgacgcgcgcgtcgcgaaaaaaaaaaaatataaaaaaaaaaaacgga

SEQ ID NO: 82590 - DNA, 303 bp, Zea mays
  Clone ID: LIB3114-035-P1-K1-B12
caacaagatacggaggttatacattaaaaaaaaaaaaaaaaaaaaaaaaaaaaaaaaaagggggaaaaaaaggggggagtgtagaaaaaacaaaaatacatgacaacggcgggcgtctttcttaggtgttcctaggttcaacctcggtccccccgttttgcggcgttttgcctgggacccccttttaattgcctggcttaacccaattaaagccctttcttgttccccccccttccttcccaccgcactggtttgaaaaggtccccctttttaaccctttcgcatactccctaatagttggtg

SEQ ID NO: 82591 - DNA, 89 bp, Zea mays
  Clone ID: LIB3114-035-P1-K1-B2
atatgggcggccgggctagaggacccaagctatagctacgcgttcattctactatatagctctcttatagcgacacatagatcgaattt

SEQ ID NO: 82592 - DNA, 293 bp, Zea mays
  unsure at all n locations
  Clone ID: LIB3114-035-P1-K1-C10
cagactggtaaacgatgtaacatgtttgataatcaataaagtgcgtcgtatggctttccgtggaaaaataaaatggggaggtaaagaaaaataaaataaataaactgagcagaagatttacaacggtgggccttgtaaggccccggccttacccacctttgcttgctttgcagcttccttttcttttgggtggcttgcgttcttttttttgggcgcccgttcttgtccttctttctttgnnntgccttgctgtttgcgactgggtcccttctgtacatgccccttttgccggt

SEQ ID NO: 82593 - DNA, 438 bp, Zea mays
  Clone ID: LIB3114-035-P1-K1-C2
cttattgtcctgctaagagatggacggaaactgcttggcaccctctgctcatttgatcagtttgcaaatgttgttcttcagggtgcttgtgaacgagtgattgtgggggaacaatattgtgatgttcctcttgggctgtacgtaatccggggagagaacgttgttttaatcggagaattggatcgcgaaaaggatgaactccctgctcacatgacctgtgtttcagaagcagaaataagaaaggctgaaaaggcagaacgggaagccagagatctgaaagggacgatgaggaaacggatggagttcctggacttcgattaacaccgtcaccgcggccgttgccgctccccattgtggcggaatctttagtggcggcctgtgtgccatacatgcctggtgaccgcgccggcgcaccttggattgctggagggtttagcg

SEQ ID NO: 82594 - DNA, 142 bp, Zea mays
  Clone ID: LIB3114-035-P1-K1-C3
aaaaaaaaaaaaaaaaaaaaaaaaaaaaaaaaaaaaaaaaaaaaaaaaaaaaaaaaaaaaggggggggggtctaaaggagccagggttacgtacgcacgcatgcgaggtcatagctcttttataggggcacctaaattcaat

SEQ ID NO: 82595 - DNA, 397 bp, Zea mays
  Clone ID: LIB3114-035-P1-K1-C4
cactagaaatatgataaacagcggaccatgtatgaagaaccaatcaaacgcgcccaatcgcgcggcgggatagctcttggtatagtgtaactcaaaaatcaattcactggccgggggggggcaactttagggactccgaaaatccctgtccgcttcctcagctataattatacttgttttacggggacctctcattagatttcctagccgcgaagattcccacgccgttcctggtaaaccactggggttcaccatgaaaagggcctgggacaccccccgtttttgcccatttggcgcattaggggagagggctacacgcattgtcatcgctacaattgcccgccccctatgggccaatggtaccgctcttttacctgcctttatagccgcgtggggg

SEQ ID NO: 82596 - DNA, 293 bp, Zea mays
  unsure at all n locations
  Clone ID: LIB3114-035-P1-K1-C6
acagaatgtgctatgatttgtactgctataatttttaacgaagatacaaacttctacaggcgtgcgaaaaaaagggggggaaaaaaaaaaaaaaaaaaaaaaaaaaaaaaaaaaaaaaaaaaaaaaaaaaaagggaacaaaggagggggggaagcggaaaaaaggaaattggggggggggtctttaggttcatttggtggggtctgcggggntggagggttttgggggggggtttggtgggatttggtcttgttttttatgggtggggggctgcgcctccccttcgggccggg

SEQ ID NO: 82597 - DNA, 201 bp, Zea mays
  Clone ID: LIB3114-035-P1-K1-C7
aaaaaaaaaaaaaaaaaaaaaaaaaaaaaaaaaaaaaaaaaaaaaaaaaaaaaaaaaggagagaaaaaaaaaaaaaaaaagaaaaaaaaaaaaaaaaaaaaaaaaaaaaaaaaaaggggggggccgttttaaaggatccaagtttacttccccgtgcttgcaacgtaatagtttttttttaggggcacctaaattaaatta

SEQ ID NO: 82598 - DNA, 202 bp, Zea mays
  Clone ID: LIB3114-035-P1-K1-D10
aaaaaaaaaaaaaaaaaaaaaaaagaaaaataaaaaaaaaaaaaaaaacaaaaaaaaaaaaaggaaaaaaaaaaaaaaaaaaaaaaaaaaaaaaaaaaaaaaaaaaaaaaaaaaggggggggccgttttaggggatccaagtttccttacccttgcatgcaaggtaatactttttttttggggccccctaaattaaattaat

SEQ ID NO: 82599 - DNA, 68 bp, Zea mays
  Clone ID: LIB3114-035-P1-K1-D11
aaaaaaaaaaaaaaaaaaaaaaaaaaaaaaaaaaaaaaaaaaaaaaaaaaaaaaaaagagaaaggaaa

SEQ ID NO: 82600 - DNA, 344 bp, Zea mays
  Clone ID: LIB3114-035-P1-K1-D3
aaaaaaaaaaaaaaaaaaaaaaaaaaaaaaaaaaaaaaaaaaaaaaaaaaaaaacaaaacaagggagggggaacaatctaatggggggttacactacatccaattcactctcctatattctaccctattttcactgtactagcacctttttattccaccgccgaggttgaaaaaacccaattcttacccaacttattcgccttgcataacatactcctttccccagcttgccttttatcaaataggccctctcaaatcaccttgccaaactgtctgtcatgccgaatataaccatgcccccgccctttaaccgctcattatgcccgttagtcttgatagttacc

SEQ ID NO: 82601 - DNA, 419 bp, Zea mays
  Clone ID: LIB3114-035-P1-K1-D6
gatcaaggaacccacttaatgtgattaaagctctcttcatagctttgaatgctattgaaaccccgaaggatgtccaacagaagtttgggcgtactgtcgtcgagtcatatttattgtgatcatcatgattgtttggaggacacagaggcgagcggagcctgtataggttttgccatgagaagaccaaagaggcaaatgccaggtccaaccaacgtgagccctctttgttttggacttttggtggtgatgttgaccagaccattgatgttgaagtggcaagaatgtcagtgtcaacagtaatcggataaatagatggtatttccctgaccctttgtttgtagaacttgaatgaacctggggacagaaacacatttgagggttcttgtataaatcaaggtcaagatcagaattgcctcgtc

SEQ ID NO: 82602 - DNA, 375 bp, Zea mays
  Clone ID: LIB3114-035-P1-K1-D9
gcggcggcggctacggtggtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgcttaataga

SEQ ID NO: 82603 - DNA, 421 bp, Zea mays
  Clone ID: LIB3114-035-P1-K1-E11
cgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccagctcgccagcgccaagtgagcaccttttttttgcctttttcgtttccgaggagggcgtcgtcgatgccaatttgtttccaataaacagggctgtgcccgccgttctgttgtactccgtctgtggttaggttagtagttttcttgatctcgcccccacgc

SEQ ID NO: 82604 - DNA, 429 bp, Zea mays
  Clone ID: LIB3114-035-P1-K1-E12
aaaaaaaaaaaaaaaaaaaaaaaaaaaaaaaaaaaaaaaaaaaaaaaaaaacaaaagggagggacaaaaaaaaggggggtgccatctctccttcaccttccttaatattcatacctattttctttgtatttccactttaatttcaccgaaattcttttgccaccccacttactaccacatactttaacttttaccatccttaatcccttttttattacataccgtttttacacagttcgcctttccctttattttcccacacagattgcccttctaaactttccctgtacctttacttttaacttcttctattactttgtggcttcgtctcttttatcccctctccttttgtaccttaccctttttcctgcccccccttccctttttaatctctctctttttccacccctcctttatctttccaattcc

SEQ ID NO: 82605 - DNA, 434 bp, Zea mays
  Clone ID: LIB3114-035-P1-K1-E4
aaaaaaaaaaaaaaaaaaaaaaaaaaaaaaaaaaaaaaaaaaaaaaaaaaaaaaaaaaaaaagaaaaagaaaaaaaaaaaaaatagagaaaaaaaaaaaaaaaaaaaaaaaaaaaaaaaaaaacaaaagggggggcccgtttaaagggaccaaagtttcatccccctggcttgcaaggaaatactttttttatggggcccccaaaattaaatacacggcccggcttttaaaaacttcgaaccgggaaaaaccctgggtttcccaaattaaatgccttggaaaaaaacccccttttccccagttggggaaaaaacaaaaaggcccacccctatcccctttccaaaaatttgcccaccttaaatggcaaagggccccccccttttagcggcccataaagcccggggggggggggggttacccccaggggacccttt

SEQ ID NO: 82606 - DNA, 421 bp, Zea mays
  Clone ID: LIB3114-035-P1-K1-E5
caaaaaaaaaaaaaaaaaaaaaaaaaaaaaaaaaaaaaaaaaaaaaaaaaaaaaaacaaaaaggaaggggaaaaataaagaggggggtatcccaatctataatttaatccaacttctataaaattaacctcatccatttctttcttttatccctatttattatcctagggggcccccctttaaaaatatccatcttttctcccccctccttcccatttatttcctttttttttgtccccccaaattatattcccccccccctctttccccactccatcccctggaaaacccctctccttccccccctttttccctttgtaaaaaccccccttttccccttctttcctaatttaaataacccccacccggttcccccccccccctcttttcccccccttttttggttaggttcccccccttt

SEQ ID NO: 82607 - DNA, 291 bp, Zea mays
  Clone ID: LIB3114-035-P1-K1-E9
cccacgcgtccgttttttttttttttgatcacacaactcctatcacctaatgcatgattgaaggtgataaaactttttaaaacagaaggaggtggcaaatgcaccggggcttgcttggataacactaggttagtgttgttagacgacgtccgcttgacgaccatcttttgtcttgacattcgtcagattatccatcttcaggttcgtccgactgacgacgtcgtcttgcggcagaggtccactcctagcaccatcttgaggtcaacttggctcgtcttccgcatcacggac

SEQ ID NO: 82608 - DNA, 445 bp, Zea mays
  Clone ID: LIB3114-035-P1-K1-F1
aaaaaaaaaaaaaaaaaaaaaaaaaaaaaaaaaaaaaaaaaaaaaaaaaaaaaaaaaaaaaagggaagggacaaaaacttgggggggtccaactcttttttttttccccccaattttacttcattggccttcttttaacaaacttctttttgttaaaaacccatttacttacctaacatatttttttacaccttaaaaacccctttattctccaagtccatccccatttaaacgccccttccctttaccccttttcatcatatcaccatctttaactaacatttgcaccttctccccattccgaactatttctaaatcgttagctgtctttctaaaagatccattcttaccctttcttgcatgctaccccacacctcttctatattttacccaaatttatattcactgcccgtcgttttactacttcatgtctataaaaacccct

SEQ ID NO: 82609 - DNA, 435 bp, Zea mays
  Clone ID: LIB3114-035-P1-K1-F11
ggcgccggcagagacaccgtcggaggcggcggtggtagaggagaagaaggaagaagagaagaaggaagaggaggataagccggctgccgaagaggcggcgccgccagcagcagctgctgctgctgctgaggagaagtgatcctgtcgacggatcgagcatgcaaagcgctccctcctcgctcccttgcttgctgctggtaaattaaattaagttgccgtgatacttaagcgtagccgcacggagtgaaaagttatcaagtaaaagcagacaaacacttggcatgcatggacattaatttgttattctttgtaccgtcgtcgtctcgatgaaccgcgtgtacatttgtagtgtggggttttctttgtttccgatttgggggtgatcattacaagaatgtgtaattatttatgttcatatgtttgttgatgatggaa

SEQ ID NO: 82610 - DNA, 194 bp, Zea mays
  Clone ID: LIB3114-035-P1-K1-F3
cccacgcgtccgaaaaaaaaaaaaaaaaaaaaaaaaaaacaaactaaaaaaaaaaaaacatgcggcggggtaaatatagtatggtggtccctaaattcaaactcactggccgtccttttacaacgccgaaactgggtaaactctggcgtgtcctaactcattttttttgcggcatatcctcctttccccagctg

SEQ ID NO: 82611 - DNA, 298 bp, Zea mays
  Clone ID: LIB3114-035-P1-K1-F5
gcaaaaaaaaaaaaaaaagggggggccctttttggggacccaatctttcctcccccgctgtggcaaattattgtttttttttgggggcccctaaataaaaaacacgggccgggtttttaccacctgttgggtggaaaaacccggggcgccccaaatttaattgctttggagcccatccctttttcgtcgggggggttaattagaaaagggccccctccgttcctctttccaaaattttcccccccctttttgggaaatgggcccccccctcaactgggtcattattgccggggggggg

SEQ ID NO: 82612 - DNA, 447 bp, Zea mays
  Clone ID: LIB3114-035-P1-K1-F6
gaaacatcttgtgtacgctagtagtaatgtgtgtgaaataaaactattgtacaatttgttgcccctcacctgtcatggcaactcagtaattctgtacctgtttaccacggtagctgcggtttttgctcttgcagttgtaatcatttctgtaactgttgtaactgtatccaccgaactgtaatatgtaaaggaagtatatgagaaagctgcactcttgtctgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggcccttttaagggaccaaagtttacttcccggggcttggaaggaaaaagtttttttttggggcccccaaaataaaattaacggg

SEQ ID NO: 82613 - DNA, 431 bp, Zea mays
  Clone ID: LIB3114-035-P1-K1-F7
ccccgctgagctgcttggttataggaagcaggggccttggcaagctcaagagggtgctcttgggaagtgtcagcgactatgttgtgaacaatgcaacctgccctgtcaccgtcgtcaagtcaacaagcaccgaaggttgatcttatcgccgagatgcctggatgtgatgttgtaataaagatggttggcctgatgaagaacatgcactagtttctagctatttgaaacatgttgaacgaggcaattctaatgtaataataatagacaaagtgccttatgaaggacatggttgacatgcctttgttgctgtatgagtgatgtttatagttttgagggtttgaagatgtggatcatttgcctattattcttccgctgtgctgtatgagcgatgtttatcaatatgcaatgcaaataaagaaacactacagatg

SEQ ID NO: 82614 - DNA, 199 bp, Zea mays
  Clone ID: LIB3114-035-P1-K1-F8
aaaaaataaaaataaaaaaaaataaaaaaaaaaaacaaaaaaaaagataaaaaaagaggctgggggaaaatgtaaagcgagtatattgtaaacaaatgcaacctgccctgttcaccttacaacaagtcgggcgggcgctttagggtgatcttatttttttacatgccgctgctgtgatgtttttttttttatggttggc

SEQ ID NO: 82615 - DNA, 111 bp, Zea mays
  Clone ID: LIB3114-035-P1-K1-F9
agccaccagagggaccatgccctttgctttgatctggttcgccttttcagttccccacagctgtgcctgtgttgtgtcttgtgtttcggaagtggagggtttcattccaaa

SEQ ID NO: 82616 - DNA, 424 bp, Zea mays
  Clone ID: LIB3114-035-P1-K1-G1
cccacgcgtccgaaaaaaaaaaaaaaaaaaaaaaaaaaaaaaaaaaaaaaaaaaaaaaaaaagaaagggaaaaaaaaaaggaggaaaaaaaaaaaaaaaaaaaaaaaaaaaaaaaaaaaaaaaaaaaaaaggggggggccgttttaaaggatccaagtttacttccccgtccttgcaacgtaaaactttttttatagggccaccaaaatcaaattaactggccgtggtttaacaacgtcgggactggaaaaaccctggcttacccaaattaaatcgctttgcaaaaaatccccttttccccagttggcgaaaaaacaaaaaggcccccaccgatcccccttccaaaaatttgcccaccctaaatggcaaatgggaccccccctttaccggcccataaaccccggggggtggggtggttaccccc

SEQ ID NO: 82617 - DNA, 238 bp, Zea mays
  Clone ID: LIB3114-035-P1-K1-G11
aaaactaccgctctgatccaaaagagcgtgtagcttagtggttacaagggccacaatgccacattagtattttatggtctggcttcgactctctgtagaagggaaaaaaatacgggagataatgaattcagatgggggacgatggcaggtcaattcagccattcttgtttctaaaaaaaaaaaaaaaaaaaaaaaaaaaaaaaaaaaaaaaaaaaaaaaaaaaaaaaaaaaaccaaaa

SEQ ID NO: 82618 - DNA, 431 bp, Zea mays
  unsure at all n locations
  Clone ID: LIB3114-035-P1-K1-G12
agttaacctctagctttctctctctctcccctctagttttccttgtcgtcttgtttctcccagttcggtgagtggttagtgtgacnattaataagaagatgatgatggcgtcccagtgattaacccgtgcggtaatgtgatagaagaagtcgtaggctgtctccgctcctcccttcctccctagctcaggattcttttgtagcttgggtttattctcatctgcttcgatcgctcttcgatgaatgcatcttgaaatgttcattcagatcacaccatcatgtatgatgtatctttcatgtgcttcttgctgaacgtcctgtagtgtacctctggctgctgctgctgctgctgcaagcagattaaccgttgttcatggcttgcttgtatcatctcataaccataattactgatctgtacttcagagaaacctg

SEQ ID NO: 82619 - DNA, 335 bp, Zea mays
  Clone ID: LIB3114-035-P1-K1-G2
cacggcgctgttcgtcgcggtggactacgcgttcctgctcgccttcgccggcttcctcgcctacctcgtcgggtcgcggatcctcccctccgccgccggctccgcctagaccggcccgcgttcgtggatctctcttctttcttccacgttttttttggagccgatggctgcgggagcaccgggatcttgccgggtggttctcgtctcggaatcgatctcgatctgatgccgctcccgcgatgtaatctggcgacaatttgacgagaagagaactagcggtgtgtttcttggcaactcgcctggtaatgtgacgcatctttccttattctgttgct

SEQ ID NO: 82620 - DNA, 104 bp, Zea mays
  Clone ID: LIB3114-035-P1-K1-G7
aaatataataaataaaaaaacaaacaatataaaaaaaaaaaaaaaaaaaaacaaaagggaggggaataataaatgagggggaaatataacctaaaaaataaatt

SEQ ID NO: 82621 - DNA, 68 bp, Zea mays
  Clone ID: LIB3114-035-P1-K1-H11
aaaaaaaaaacagacacaaaaaaaaaaaaaaaatataaaaaaaaaaataaaaataaaaacaggaaaaa

SEQ ID NO: 82622 - DNA, 441 bp, Zea mays
  Clone ID: LIB3114-035-P1-K1-H6
aaaaaaaaaaaaaaaaaaaaaaaaaaaaaaaaaaaaaaaaaaaaaaaaaaaaaaaaaaaaaaggaaagggaaataaaaaagggagggaaattctataaaaaaaaaaaaaaaaaaaaaaaagggggcggccttttaaaaggttccagacttgggaacccttgcttgcaacccttttgcttttttttggggcaccttaaattaaattcatgggccgtgtttttaaaaaggcgggcttggaaaacccctgccttccccaaactaatttgctttgcaaaaaatcccctttttgcaaggtggcataaaacaaaaaaggcccgaccgtttcgcccttccaaacagttgcccatcctaaatggcaaatgggcccccccttataccggccaattaacttggggggggggggggtttacccccagtgggaccctttaatttgcaagcccc

SEQ ID NO: 82623 - DNA, 417 bp, Zea mays
  unsure at all n locations
  Clone ID: LIB3114-036-P1-K1-A11
aaaaaaaaaaaaaaataaaaaaaaaaaaaaaaaaaaaaaaaaaaaaaaaataaaaatatagggaaaaaatatataaggggaaaaaaaattttaatatataatttttataaattttattattattataattttttattaaaaaatnatttttatttttaaaattttatattatatatatttaatttgtttgtggttttttttttttttttatatttttttttattttttttaaaggttttaatttttttttttttccaacatatttttctttttttttttccatatgttattactttctttttctttacatttttttcttagttttattttttttttttttaaaattttcttttttttttttatttttttattgcccaatgattttgcttttttttcttttttttttgtttctttttt

SEQ ID NO: 82624 - DNA, 399 bp, Zea mays
  Clone ID: LIB3114-036-P1-K1-A12
gtaaggtcaaatactgcagcctttatgatcaagggtatacttccattgggagcatacacgatactgttccaaatgcactccttagtgattcatcatctgagaaaagttttagaccagcatacatgctaactgatggaaggcttgaaagagctggtagaacaaaaaagattaatcctaaagtagaaatgaattctgctgcaagcaatggcatcaacgatactgagggaggacggatgatctcacgggcggcatcaatcattgtagtcggtgatgaaattttgtttggtacaactgaggataacttaggagcagccttgtgcaagaagcttcatgcaattggctggcgggtttctcatgtagcagttgttcgcaatgagattgattctgttgctgaagaag

SEQ ID NO: 82625 - DNA, 165 bp, Zea mays
  Clone ID: LIB3114-036-P1-K1-A2
ccggaacggaattggcggggcaggcgacccaaattaaattaattacactccaatccatctcaatatatatggattaggtcgaatactgggagggtgtaatacttcaaaagcctattttggataaattagtaaaacgtatttcatgatttaaataaatatgttttc

SEQ ID NO: 82626 - DNA, 167 bp, Zea mays
  Clone ID: LIB3114-036-P1-K1-A4
cggaccggaatcccattctcggcccgaggcgtcccaaacaatacacacaaaacaatactaaatctatatttctagctgccgctctaaaacatccaagctcaggtgcccatacattcgacgtcatatcttttctatataaatacctaaatttaatttactgtccctca

SEQ ID NO: 82627 - DNA, 402 bp, Zea mays
  Clone ID: LIB3114-036-P1-K1-A7
aggaaaggacggtcccgtctctcccgatacgcttccgaagcggtcgcggagcaggtcggacggtccgccaggaagatggggttgagctccatcgtcatgaaggtgaaaggggcttcgttcttcaagaagaagaagaaggtgatcctgagcttcagagaagggttccgaggcgaaagggtgagggaccaatctcctatcatgtacatccacgacgtgacccagcttcctcacaatgggtgccggctccccaagcagcgccgggtgtagtttcggagtggactggaactagagctgggtttaaagaaagaaccggggaagtgtcggaagtgattttcggaaacttaacgtaatcgttgtgttgttggcctaattgatgtaataatatggacatgtgttttgtgc

SEQ ID NO: 82628 - DNA, 55 bp, Zea mays
  Clone ID: LIB3114-036-P1-K1-A8
aaaaaaaaaaaaaaaaaaaaaaaaaaaaaaaatttaaaaaaaaataaaaaaaaaa

SEQ ID NO: 82629 - DNA, 184 bp, Zea mays
  Clone ID: LIB3114-036-P1-K1-B12
cgtgaggcgtttatgtataatatcatccaataatggccgtaccacacttgtggtacctttgagtacgtatgcttgcattgaatgaggggtctctttcctaaaaaaaaaaaaaaaaaaaaaaaaaaaaaaaaaaaaaaaaaaaaaaaaaaaacaaaaaaaaaaaaaactagaaaaaaataaaaca

SEQ ID NO: 82630 - DNA, 361 bp, Zea mays
  Clone ID: LIB3114-036-P1-K1-B5
ggtcattcagctccagggtgatcagaggaagaacgtctcgaatttcctcgtccaggccggcattgtgaagaaggagcacatcaagattcatggtttctgagcaaccgccgggtccatagcaaaccaaccctgcatgcagggccagcttattatatataatatctgaggtggagcatatctatctggctgtgtactgcaagcaggcctagtacgccgcctgcgcgttcctcctattacacatataggcccctccctgcgtgtatgcttgttaccgtcgtgtcgaaccttgtactacgaggctccatcgaacatcgatggcttgcttctttatcagaacatgtttgaataaacgctatttggt

SEQ ID NO: 82631 - DNA, 238 bp, Zea mays
  Clone ID: LIB3114-036-P1-K1-C12
gactagttctgtcgcgagcgccgcccttttttttttttcaaaaaaaaaaacacgggggggaaaaaaaaaaaagaaaaaaaaaaaaaaaaaaaaaaaaaaaaaaaaaaaaaaaaaaaaaaaaaaaaaaaaaaaaaaaaaaaaaaaaaagggggcgccccttttaaaggatccaagcttactcccccttccttgcaaggtaataatttttttttggggcccccaaatttaaattcacggc

SEQ ID NO: 82632 - DNA, 411 bp, Zea mays
  Clone ID: LIB3114-036-P1-K1-C4
gaaggttttggatgtgggatgtggaattgggggacctttaatagaaatcgccagattcagctgaacatcgataactggactgaacaacaatgactaccacatctcaaggggcaaggagctcattttttcagcaggtttgagtgagcaatgctgcttcttgaagggggacttcatggacatgccaatatctgataacacctttgatgcggcctatgcaatacaggctacatgtcatgcaccagatgcacaaggcgtctatagtgaggtctaccgtgtgctgaaacctgggcagtattttgcactggatgaatggtgcttgaccgaccgatttgatcccaacaacgccaagcatttggccatcaaggctgagattgagctcggtgatggcctacctgacatccgtaccactcg

SEQ ID NO: 82633 - DNA, 64 bp, Zea mays
  Clone ID: LIB3114-036-P1-K1-C9
aaaaaaaaaaaaaaaaaaaaaaaaaaaaaaaaaaaagaaaaaacaaaaaaaaaaaaggaagggg

SEQ ID NO: 82634 - DNA, 102 bp, Zea mays
  Clone ID: LIB3114-036-P1-K1-D8
aaataaaaataaaaaaaaaaacaaacaatataaaaaaaaacaagcttacatacacagacgggcgacaacatgggggtggtataatatcacctaaattcaatt

SEQ ID NO: 82635 - DNA, 396 bp, Zea mays
  Clone ID: LIB3114-036-P1-K1-D9
aaataaaaaaaaaaaaaaaaataaacaaaataaaaaaaaaaaaaaaaaaaaaaacgggggggaaatataaaagggggggaaataaataccctttatttctcctccccttctatattttccttacttctcgtctattctttccctctcttcacctttcttcggtttccctaaatttatttcccttgcctctcctttttattttatgattggcacaccctttctttccccaactttttctccttttctttcttccccttttccccttttcccttaataaccctctctttccccccctttttccctcccaaaaagttctccactcttactttgtaactctaccccccctcactcttgtcttttaacccctttttttttgtcctttcccccctttttccc

SEQ ID NO: 82636 - DNA, 406 bp, Zea mays
  Clone ID: LIB3114-036-P1-K1-E10
ccgaatcctcctccttcaccaggcccaggtcctaccaaatgcagtctgctcacatactggcctgagggatccacctgttgttgctcatggcgtgtcttgggcttttgcctttcctggagctgttgcgaactggacaatgcagtttgctgcaaggataaccggtactgctgccctcatgactatcctgtttgtgatacaggtcgcgggcagtgtctcaaggccagcggcaacttctctgctatagaaggaatcaggaggaaacagtctttctctaaagctccctcgtggactggctggctggagttgatggaccaatgagcgtataatcagacatggatagtagcttcatgcaagttgtgcgatccgtaggtcggtcattggccttgttccagtgccctgccacatt

SEQ ID NO: 82637 - DNA, 299 bp, Zea mays
  Clone ID: LIB3114-036-P1-K1-E7
tttttcccctgcattaccgtaccttaattggggtggggagccacgcgtccgccctctctttctaaaaaaaaaataattatataaaaaaaagaaaattataataattgggagaggtaaaaaaagtggggggggtatattcttaattatataaacttacaatctttttttttctacaatataatcttttttattttctctcttaaatccaattttttttctctttttttacaatttatttactgttaaaaacctttatgttcttcaaattaattcttttttaccttatccctcttttttca

SEQ ID NO: 82638 - DNA, 434 bp, Zea mays
  Clone ID: LIB3114-036-P1-K1-E8
aaaaaaaaaaaaaaaaaaaaaaaaaaaaaaaaaaaaaaaaaaaaaaaaaaaaaaaggggggtgatttaaaaatggatgaaaaaataaaaaaaatttatataatttaaccttattttttattttctttcccgttttttttacccctttcttcttttgttttattacctttctatttcctaatttttttttttttttaccaacttatttatttttttagtttcttctcctttttaatcaagttcttttattttttcccttttttttcttattttttattttttttattatttttcatttttctttttctattttttttaccctttcttcttttcctttattcttttttacttttttctttttctatcttttctatttccttttcttttcctttccttttaccttacctctccttttctttttttctcttttttttt

SEQ ID NO: 82639 - DNA, 404 bp, Zea mays
  Clone ID: LIB3114-036-P1-K1-F3
aaaaaaaaaaaaaaataaaaaaaaaaaaaaaaaaaaaaaaaaaaaaaaaaaaaaaaaaaaggggagaaaaaataaaaagggggctaaaaaacacacacatacatactccattctctctcttttttatacccacctttctttaattccctgtccttacccttcttattttcctttttaaacaaccctattttcccctttttttttaatttttttttatccccccttcctttccccttttcttacttatctcttttttttccccctatctctttatccctccctcttctccccctttttacccccctaattttccccctctctttaccttttctacttttctttttttttttgttccctccacccatcctctttttttttttccttactttctctaccccttcttc

SEQ ID NO: 82640 - DNA, 376 bp, Zea mays
  Clone ID: LIB3114-036-P1-K1-F5
gaacaattgaatatctcacttgaacgttatatggcttattttaggcattaaaaaaaaagaagagaaaaaaaaaaaaaaagggaaaaaaaaaaaaaaaaaaaaaaaaaaaaaaaaaaaaaaaaaaaaaaaaaaaaaaaaaaaaaaaaaaaaaaaaaaaaccaaaaaaaaaaacaaaaaaaaaaaaggggccgtcatttaaagggtctcccctttttgcgtccttaccttaaaggccccccacctatcacccttcccaccaatttcacatccctcatggcgaatggcacgcgcccttttttaaaaccccttggcttaaaaaaccttaggccccccccaataaatcccctttacaaaaactcccttttaaccaaagggg

SEQ ID NO: 82641 - DNA, 109 bp, Zea mays
  Clone ID: LIB3114-036-P1-K1-F7
cccacgcgttcgaaaaaaaacaaaaaaaaataaaaaaaacaaacatacaaaacacggggagacaaaaaaaatagaggggggtataataaaaacataaattcaattcaca

SEQ ID NO: 82642 - DNA, 329 bp, Zea mays
  Clone ID: LIB3114-036-P1-K1-G10
aaaaaaaaataaaatccatagcaaacaatataaaaaaaaacaagcaaaaaaacacgggggggcaacgtcatggggttgtggatatccaaacttacttccacgtcaatgccaggttttaaacaacgtatagggtgacctaacccaaatgtaccgcactttaatttacaacgcatcacattgggatatccctggcttgcccaaaattaaacaggttgcaaccgatccccctttctaacagtggcgcaatttgaaagaggtccggaactcgccccgtttctaaaaattacccaccctgaatggggaagggaatcccccctgtaccggttcat

SEQ ID NO: 82643 - DNA, 239 bp, Zea mays
  Clone ID: LIB3114-036-P1-K1-G6
cgcctgcagggcccggtccggaattcccttgtcgaggcacgcgtccggttagaataccttgaggagcgggagcctcaaggatttggtcaagaagcactctgagttggtgaggtaccccatctgcctgtggaccgaaaagacaacggagaaggagatttctgatgatgaacatgaggaagagaagaaagacgctgaggagggaaaggttgaggatgttgacgaggagaacgaagagaaag

SEQ ID NO: 82644 - DNA, 347 bp, Zea mays
  Clone ID: LIB3114-036-P1-K1-H12
accggaccggaattgccggggcgagcgccacgcgtccgcaaaagaagctaaagaaaacacaaaatagaaccaaacgctcggatggaacaaaaacggcggaaaagcagacaatgggggcgccagcaccggcatgacgatgtacccgccgacggcgcaggggatgggccgctaattacgctaccagctccatcggtaaactcatatggtgttgtgttgtgtcagccagatcatcgcgttcgtacgggtatacttgtgatatgtaatgttagggaccggaatgcccatgtgtttcaagatatttcacgttcaagttctttctgtctgctactatccgaatgaaaaccatt

SEQ ID NO: 82645 - DNA, 118 bp, Zea mays
  Clone ID: LIB3114-036-P1-K1-H2
aaaaaggccaatccaattgccgcttggttttagctgtagctttgggaactgtaggcttggtgtaatacagttcgttctgtcaatgttaaggacttttgcctcgagagctaggcataaa

SEQ ID NO: 82646 - DNA, 234 bp, Zea mays
  Clone ID: LIB3114-036-P1-K1-H3
tacacaacccaagcttacttacgcacacatgccacttcataactgttctatatagccaacaaaatccaaccgattggccttcccaacacaaccgcatgactaataaaaccctggactcacccaacataatcgcattaaaccccatccctgttttgccaactcgcataataaccaatacacttgccacgatcctacttcccaatactttcgctttcttaatttcctttgttacca

SEQ ID NO: 82647 - DNA, 284 bp, Zea mays
  Clone ID: LIB3114-036-P1-K1-H6
tgcacgtaccggtcctgaattcccgggtcgagccatcgcgtccgaaaaaaaatactcaagcggcgcccgtttttgtaagcatccacacctctatctttaccccttccgtgggagaggtattagttttggtgtggggtcacctaaattcaagttactggccgcgtgttttacaacagtatagaactggtaaagcctggcctaaacccatttaattggcctgcagaaaaaaccccttttgccgggaagacttattggtaaaaaggcttaatcggttggccttacca

SEQ ID NO: 82648 - DNA, 117 bp, Zea mays
  Clone ID: LIB3114-037-P1-K1-A1
aaaaaaaaagacagtcataattcaaaataaaatagtaactctgtatccggtgctaaggtaggggtgaactattaagcagtgttgtgagcataaatataaagtaaaatagaatggttg

SEQ ID NO: 82649 - DNA, 209 bp, Zea mays
  Clone ID: LIB3114-037-P1-K1-A2
aggccggcagcgagaagaagcaccacttcttgggctgattcgatgctaccgcatcgtcagtccctccccgtgtgctacgcgtgcagtgagatgagtgatatcgagcgcccgacgtgttgtgcgcgcgtacgtatgtatgcgctcgagtgatgcacgaataagcgtggctacgtaatctatggtatgtatacaggtgtagtatgcatgtg

SEQ ID NO: 82650 - DNA, 306 bp, Zea mays
  Clone ID: LIB3114-037-P1-K1-A5
ccaagatgaggagatgcctgatgtcaggaaactggacatccgaaacttcctgtaggcctgatcgacgataacctttgaggcattgcaaatcacccagcccacctgtgattttttttttctttggttttggtttcaagttgatcggtgctgtaagctacacctatgaatgctgctccttcctttttttgtaataaaaaaactgcaccgaggtacacaaacacagtcgaccgttgtgttgtaaaaaaaaaaaattaaagataaaaaaaaaaaaataaaaaaaaaaataataatagaaaaatagaataa

SEQ ID NO: 82651 - DNA, 101 bp, Zea mays
  Clone ID: LIB3114-037-P1-K1-A7
gggggacagccatcatccatcatagtctgtactctgtatccggagcttggtgtactgaactctgaaacttctttttgctgaaaaaataatttaaagataaa

SEQ ID NO: 82652 - DNA, 335 bp, Zea mays
  Clone ID: LIB3114-037-P1-K1-B1
cggtatctatgatgagctaatgactccagggcaatgcaatatggtggtggagaggctcggcgattacctgatcgaacagggcttctaagtttgtcataatgctattttggtcattgggcacttaagtttgcacctcatttggttctgtaatatgtgggcttgtgcatgtgcttggcgtattgcatgcagtgaataatttatcttcgcgttgggttggtgacaatgttgggaacggatttgaattggggtttatgcttgccatctcctcatatctcgaactcagctgctgtttcactgagtaatgtacatttccctggtaatggaacttgtgcact

SEQ ID NO: 82653 - DNA, 97 bp, Zea mays
  Clone ID: LIB3114-037-P1-K1-B10
aaaaaaaaaaaaaaaaaaaaaaaaaaaaaaaataaaaaggaaaaaaaaaataaaagaggcggagattacatacgcgggtatggtagtaaaaaataaa

SEQ ID NO: 82654 - DNA, 297 bp, Zea mays
  Clone ID: LIB3114-037-P1-K1-B11
aaaaaaaaaaaaaaaaaaaaaaaaaaaaaaaaaaaaaaaaaaaaataaaaaaaataatgagaataaaacaaatatgacaagttgtcaaataacgaataaataaagatcatacgtcagtaaatctaatggggcggtcctttttaaggttcacatatttcctccccactgccttttacactatactttttgtttgggggcccccaatttaaatcctccgcccgtgtggttacaccgctggaccagggaaaccccctggggcccctaactaaaggcgtcttggaggacaacccctttttc

SEQ ID NO: 82655 - DNA, 302 bp, Zea mays
  Clone ID: LIB3114-037-P1-K1-B12
aaaataaaaaaaaaaaaaaaaaaaaaaaaaataaataataaaaaataaaataaaagtggaggaaataataaaaagggggtttcatgtacttttgtatttcgcgtcccttaaataaaattttaaatatttatagtaaattttgggggccccgtcttgggggccccattttttccccccttgccttcctgagtgatgctttttttttgggcctcctgatggccatttccgggcccgttttatttactagcttgtagttggtgaacccctggggcgcccctctttttttcccttgcggtccttcc

SEQ ID NO: 82656 - DNA, 389 bp, Zea mays
  Clone ID: LIB3114-037-P1-K1-B3
acccacgcgtccggctctggatatcaaaggttttgttgatggatgcagaggtgacttcctctcgacggcgaactgtggctccttcaacctcagcttcgggcctgctgacgggttcacaggagagccttctagtggtggttcgttctcgatgctacctcctgagcactttcagagtgctcagaagaaggggcagaactgaatatggataatctcagacagctttagatgtatgtatctgggcggcttcagatgcaccaccatcatctctgggtcatgctcgtttttctccactgtagtgtataacattgtcacagtttgagattggtggcttcttccttcctatggacccgcctttatcagctggaagcccgactgttgaacttttgcac

SEQ ID NO: 82657 - DNA, 386 bp, Zea mays
  Clone ID: LIB3114-037-P1-K1-B4
agatgtggttactgcagaatgcttgactgaaaaggagaagaacaagaagctgaccatggagaacgagaagctccagtaccgcatgacccatctgattcgtgcgataaaagaggcggaatcgagataggagcagcccggcgaggccgattcaaagcctgatgtcgaagtgttccccacccgccttgctgatcctacacgctgttcctgcatctacctcaagttatcattgtgatcttgagatagagcttggtcacaagtcaagactgtattatcaaactgtcgattgaaaatgatgatgtgtgcacagctttctgtcttcacctgaccccatctcgaagggcacattggaacacaaaatgttatctgaaatgacagttcatattttg

SEQ ID NO: 82658 - DNA, 453 bp, Zea mays
  Clone ID: LIB3114-037-P1-K1-B5
caagaaaggtaaggatagcctttcagctcaagggaagcgacgttatgaccgcaaacagtctggatatggtggtcagacaaagcctgttttccacaagaaggcaaaaacaacaaagaagattgtgctgaagctgcagtgccagagctgcaagcactactctcaacacccgatcaagaggtgcaagcactttgagatcggtggtgacaagaaaggcaagggaacctctctgttctaagcgtatcataaacttgctcagggtctcaagtatctgtcagaatttaccattacaaacaccctgtgcttagcttctgcatatgttcttttgtcacatctttttggtacgttgtagtttgtatgagaccaagctattgtttcgagttattattatatttcatgaaattgtcaacatgaccgtttgcttgactgtaaacatagttctgagctttgggcaaa

SEQ ID NO: 82659 - DNA, 266 bp, Zea mays
  Clone ID: LIB3114-037-P1-K1-B6
gcacccagcagtcaaaaccaagatgtacttagagtagaacaagatggaaagacggaacctcacgacgccgttgctgaaacctttgctcagaagctgagcatgtagtgtgcttgttacacccatgatgggtacattgagaccatttatgttgtattagtaatatattgtttgattgcccaattaacggggtgagccattgtttcatcacaacatcgatgtgttagcagataaccacatcgccgttttaagcaaacattgagtgcgga

SEQ ID NO: 82660 - DNA, 206 bp, Zea mays
  Clone ID: LIB3114-037-P1-K1-B9
ccacgcgtccgaggccgaggaaaccttcgactacatgccgaggacggccaagagcgcgttcaccggccggtgagcgcgtagcttgtaaggagtacgtatctttctagagttgtgggtagactacaagcaacaaggcgggaatgtgctagtgaaagatgtaacggcggcatgtgacattccaattatcattttggcgatggctcctc

SEQ ID NO: 82661 - DNA, 51 bp, Zea mays
  Clone ID: LIB3114-037-P1-K1-C10
aaataaaaaaaaaaaaaaaaacgaacaataaaaaaaaaaaaaaacaaacaa

SEQ ID NO: 82662 - DNA, 300 bp, Zea mays
  Clone ID: LIB3114-037-P1-K1-C11
ctcgagaacgtcatccgcgacgccgtcacctacacggagcacgcccggcgcaagaccgtcacagccatggacgtcgtctacgcgctcaagcgccagggccgcaccctttacggcttcggcggctagggcgctaggctaggccatgctcgacccgccccccactctccgctctggcgtcgtcactggttccttgacccctgtgcgggtcggtcggtggtgctagggtcagcagttgtctggtgtctgtagcctctctggctatccgttctttggtgtgaaatggaattccaatcgggtggg

SEQ ID NO: 82663 - DNA, 224 bp, Zea mays
  Clone ID: LIB3114-037-P1-K1-C12
caatgtgatactagctgtcagctgtttgtcttgcttactgctgtacttatcaaagagaggttcgatgctttagtcgattcgagtaatcgagtctacaagattgaactttgtcgcttcaaaaagataaggcgctaggctaggccatgctcaacccgatcccccactctacgctcaggcgtcgtcacataggttcctagacccctaagcgggacgggcggtggtgc

SEQ ID NO: 82664 - DNA, 346 bp, Zea mays
  Clone ID: LIB3114-037-P1-K1-C2
cccacgcgtccggccagatccatggcttccggatgtctctttggtacgaacacctggggatgctggacgacgtgttccagcgccccgagagcgtagagtgcgtgcagaaggtgaacaagatcgccgtgaagtactgggacctgtactcgagtgatgacctggagcaggacctcccgggccacctactcagctacccgatcggtgtcactgccgacggcaccgttactgatctgcccgggatggagaacttgcctgacacccgtgcccgcgtgctcggcaacaagtgggattacctcccgcccatcctcaccacataggctgcatgctgcaggcagcgccatgggtt

SEQ ID NO: 82665 - DNA, 209 bp, Zea mays
  Clone ID: LIB3114-037-P1-K1-C4
taaaaaaaaaaaaaaaaaaaaaaaaaaaaaaaaaaaaaaaaaaaaaaaaaaaaaaaaaaagggcggaactttatgaaggagccatgcttacgaacgcgtgcatgcgaagacttatctcttttatagtgtcaccttaatttaatttactggccgttgttttacaacggcgggactgaaaaaactcgggagctaccaaatttaactatttt

SEQ ID NO: 82666 - DNA, 171 bp, Zea mays
  Clone ID: LIB3114-037-P1-K1-C5
taaaaataaaaataaaaataaaaaaaaaaaaaaaataaaagaaaaacactttaaaacaagaccgggacacgggcgcagggtttccaagtttcggccctccttctgccggcgcccatttttatttccttggtcgggcggtccaatttcgtgtgccggggcccccatctttca

SEQ ID NO: 82667 - DNA, 447 bp, Zea mays
  Clone ID: LIB3114-037-P1-K1-C8
agacgagctcgttcaagctggagcaccccctcgagaagaggcaatctgaggctaaccgtatcagagagaagtaccctgacagaattccagtgattgttgagaaggctgagaggagtgatattcctgacatcgacaagaaaaagtacctcgtccctgcagatcttacagtcgggcaattcgtgtatgttgttaggaagagaatcaagctcagtgctgagaaggctatcttcatatttgtgaaaaacacccttccaccaacagctgctctgatgtcttcaatctatgaagagaacaaggacgaggatgggttcctctacatgacttacagtggtgagaacaccttcggactgctctagatggcccgcaatggggtcgccttgcccttgcccatgcctcctgtaaataagacctgccaagcaactgtgtatattctggtttcgtcgtcgc

SEQ ID NO: 82668 - DNA, 86 bp, Zea mays
  Clone ID: LIB3114-037-P1-K1-D1
cttgtactcaccctaaaaaaaaaaaaaaaaaaaaaaaaaaaaactaaaaaaaaaataggatggtaaaaaaaaaggaggggggatat

SEQ ID NO: 82669 - DNA, 139 bp, Zea mays
  Clone ID: LIB3114-037-P1-K1-D3
gggaggaagcatccagccgatttctgctgagaggctaatgaacataggatggacttttcaatagctagatgtaatcagaactggtttatattttctctgctaacatggcgtagtagccaggacactttgcttgtcgatt

SEQ ID NO: 82670 - DNA, 64 bp, Zea mays
  Clone ID: LIB3114-037-P1-K1-D5
gtctctaaataaaaaaaaaagagaaagataaaaaaaaaacaaacataaataacgcttacagggg

SEQ ID NO: 82671 - DNA, 54 bp, Zea mays
  Clone ID: LIB3114-037-P1-K1-D8
aaaaaaaaaaaaaaaaaaaaaaaaaaaaaaaaaaaagtaaaaaagaaaacaaac

SEQ ID NO: 82672 - DNA, 402 bp, Zea mays
  Clone ID: LIB3114-037-P1-K1-E1
ggggagtaatcaagcagggcgatgtgggcctatacgtgttcgcatccaagccgtcgagcggcgcggccatactgaggttgtaggcaggcaggaaggcagaggcagccgctattcttttcacgagtgtggtggccctgtaaaacatggaataaagttgccatgaacaccgaacccttgtagtagcgttgaattatctcagacaacacgcgcattaaattgatatcaaaaaaaaaaaaaaaaaaaaaaaagttaatatgaaataaattagaaaatgaggaataaaaaaagaaaaatttaaaaaaaattaaatattggggcggccgctcaaaaggaaccaagctatcggacccgtgcttgcgaagttatatcttttttttgagggcacctaaaattaaattaccg

SEQ ID NO: 82673 - DNA, 133 bp, Zea mays
  Clone ID: LIB3114-037-P1-K1-E11
aactaaatatatgatcgagagcggacgatctagaaagatccaagcttacgaactcgagggggcgacgatataggggtgttataatgtcacctaatttcaatttactggcctttatttttcaacgtgtggactt

SEQ ID NO: 82674 - DNA, 272 bp, Zea mays
  Clone ID: LIB3114-037-P1-K1-E2
aaaaaatagaaaaaaaaaaaaataaaaaaaataaacaaaaaaaaaatacaaaacaatataaaggggcgatcatactatagtgcttagtctaactctagtttcacttgcactcttatttacccccaacaaatgttagtgggcctcccagttacattgcgtatgatttcttggggccccccgctggggttaccctttttttttatcccctctctgctcacttcttttttgggcgtttgtttccccctagttaatggtaactcccccggcttttc

SEQ ID NO: 82675 - DNA, 404 bp, Zea mays
  Clone ID: LIB3114-037-P1-K1-E5
gaagtgcgggcaccttgcttttgccttctttttgtggaaacctgtgcctagccataatgctgggttaagtgttaggagcatctctggaatgcttcgcgtagtatcttttgattcttctttccttcgtgttacatgtgaaatgcctgatgaactcaaataatgaccggtgatacaaaaacctgtgatgaatttacttcggggttttgatcatgtaattgtaaacatggcatgtcgtctgcacacttaatgttgaagcttgattcacttcaaaaaacaagaaagtaaattcaacaaaccggaatgttatgatagataataacatagttatatattacattaaccggttaagaggttactcttaatattttgttcataatatttgggggcggcccctttaaaggaac

SEQ ID NO: 82676 - DNA, 285 bp, Zea mays
  Clone ID: LIB3114-037-P1-K1-E8
atttggcaggcgtcatgtggtttcgtgatccacgcggggatgggaggagccgcatgagatgctgagtgattggacggttagttggcctcctcacgtggcgcgtctctgcacctttgtctctctggctgactgactggctctgctttcgcctgcgcctgggcatatcgtggaaccctgattggcctagctcgatacggccgcagctatcatgtggtgtttgtttcagcttattttcagcttctggcagctgtggaacatttagctttttaactcgtttttgtgaga

SEQ ID NO: 82677 - DNA, 347 bp, Zea mays
  Clone ID: LIB3114-037-P1-K1-F12
aaacgaattaccctcggtgccctccctctcggcggcggcgcaagtccccttcatgtccggcgcggcaaatggcaggtggcaaggttgcacatgctaccctcaagggccccagcgtggtgaaagagatcttcattggactgaccctgggtctgatcgctggaggtatgtggaagatgcaccacttggaacgagcagaggaaaacttgatccttctacgacatgcttgacaagggccagatcatgattcgctacgaggagaggtttccacgtgtcacctcagaaagttttttttccagggggttgtgaaaactcactctggggggcacgacaaaaatgatgctgtggag

SEQ ID NO: 82678 - DNA, 146 bp, Zea mays
  Clone ID: LIB3114-037-P1-K1-F4
aaaaaaaaaaaaaaaaaaaaaaaaaaaaaaaaaaaaaaaaaaaaaaaaaaaaaaatataaaggggaaaaaaaataaaagaggggggtgctgggccggcggttctctggttccctactctggttccccggggtggggccttttatat

SEQ ID NO: 82679 - DNA, 246 bp, Zea mays
  Clone ID: LIB3114-037-P1-K1-F5
cccacgcgtccgcccacgcgtccgcccacgcgtccgacttagtgtgtcccatgttgtttttcttagtcgtccgctgctgtaggctttccggcggcggtcgtttgtgtggttggcatccgtggccatgcctgtgcgtgcgtggccgcgcttgtcgtgtgcgtctgtcgtcgcgttggcgtcgtctcttcgtgctccccgtgtgttgttgtaaaacaagaagatgttttctggtgtctttggcggaat

SEQ ID NO: 82680 - DNA, 301 bp, Zea mays
  Clone ID: LIB3114-037-P1-K1-F6
cccacgcgtccgacaccaacgggcagggctaccagatgggccacctcaacgtcgactaccagttcgtcgcctgctgagcaacagagctcagccagatccttcctgtgtatgtatgcatccatgcatgcaggcaggcagatgcagagaccgacgtcgttgtaaaacgcgtggccttacttgagatgaataaaacgcaacatgtagcgtcttgcaactgtcgcaagcacagctactactgctactgattaaataaacaggactgcaatgatagtaataaactatttaggcctcgttcgttttg

SEQ ID NO: 82681 - DNA, 303 bp, Zea mays
  Clone ID: LIB3114-037-P1-K1-F7
cacgagaagaagaaggaccacaaggaggccgaggaggccggcggcgagaagaagcaccacttcttcggctgattgatcctcccgtatcgtcgtccctccccgtgtgctacgcgtgcgtgtgagagtgatatcgagcgcccgccgtgttgtgcgcgcgtacgtatgtatgcgctcgtgtgatgcacgaataagcgtggctacgtaatctatcgtatgtatacgtgtgtgtatgcatgtgcttgagtatgatcgtggtacgaggaccgaaaaaatgtatgcaactctgatttacttaaatgtaga

SEQ ID NO: 82682 - DNA, 399 bp, Zea mays
  Clone ID: LIB3114-037-P1-K1-F8
ggctctccttcccccttgtcgccggcgccgtcgtgatcggagtgatttctgggaatgtgatatttgggccaccgcttcagaagtactgggcagagaagcagcagcaagaggcagcaaaagaaggccaagctggttcaacctgacaaaatgtcctccccttctgcagttacacggagaaatgtgtactcctcggtcctgaactagcatcggcttttgttagcattggttacatttagttgcccaagttttcggcgctggaagaagacaccgtgcaatgcacagaaagatttgaaaaacggttaaatgctgggtgatctcattctgaaatacaggacctttgatgaatgcaccgtgcaagacacggtggagacaccttcgaatgatttcaaagcctccttg

SEQ ID NO: 82683 - DNA, 296 bp, Zea mays
  Clone ID: LIB3114-037-P1-K1-G12
gcctgcagtaccggtcctgattgccgggcccgacccatccgcgttcgtaaaataaaaaaaatatttacacaaaaaacaagcttagcaagctagttaaccaatgcggggtgcgaacagatatagtggagtctatcctaaacataaaataaaatgtaaaataaattaaatgggggggcctttttaggagtcccacattttacgttccctgcctttgagcgcttaaacttttttttaagtccccctatataaaattaactggccgagggtttaaccccgtggtaacaagaaaaaccccg

SEQ ID NO: 82684 - DNA, 409 bp, Zea mays
  Clone ID: LIB3114-037-P1-K1-G3
ggtagcagtcataaccttcctggacttggtaataatggacttgttctgtgggaacatacaaggcaggagtggactgaaactagaagtctgcggctgaaggtgaagcaggttcgtgaaccagtattgagttggaatgcagcatatgagagtctgcttggatcaaataagccatttcctcaacccattcctcttcatgagatggtcgatttccttgtggacatctgggagcaggaggggctgtatgactagcgcaaatgatttcatgggataacatctgggataacacatagttgttcctcaagagaggggaaaaagaatgacatagagggtgtaggcttgggatgtggtgatgagttggcctgtcatacttggtttttgtcaatggaggcctgctgtacttgcagaatac

SEQ ID NO: 82685 - DNA, 409 bp, Zea mays
  Clone ID: LIB3114-037-P1-K1-G6
agaaggctgctgaagagcgtgctgcagctgccaaggcttctggcaagaagaaagaatctgggaagtcatcagttttacttgatgtgaagccatgggacgatgagactgacatggccaagctcgaggaagctgttaggagtgtccagatggaagggctgctctggggcgcatccaagcttgtcccagttggatatggtatcaagaagctgcaaatcatgatgaccatcgtcgacgaccttgtctctgtcgacactctcattgaggactatctgtgcgctgagccagtgaacgagtacgtgcagagctgcgacatagttgccttcaacaagatctaggcgtgacttccgatcagtccttcccctgaggtgctggcgattgtggtggctgggcaatgcaccagcctaattta

SEQ ID NO: 82686 - DNA, 59 bp, Zea mays
  Clone ID: LIB3114-037-P1-K1-G9
aaaaaaaaaaaaaaaacaaaaaataaaaaataaaaaaaaaatacaaacataaatgatgg

SEQ ID NO: 82687 - DNA, 191 bp, Zea mays
  Clone ID: LIB3114-037-P1-K1-H10
gtaatagacgctttgctgtatcgagatgcaagcttgcagcttggcaacctggccgaagacgggcaagctcttttatgctgctcccataaaacagttggcggaaacgtccgtgtaccacctatgtatttgttaggaatcagatgcctcaagctggtttagccgcgttcataatagattattaaaaccgctga

SEQ ID NO: 82688 - DNA, 225 bp, Zea mays
  Clone ID: LIB3114-037-P1-K1-H4
cggaattgccgggtcgacccgcgcgtcccatacaaaaataggccgcttggttgcttcgggatgcaggcttgcagcttggcaacctggccgaatttggccagtttcttcatgcctcttttatcaagttgttggtggaaaggtgcgtggaacacccttggattttgtgggaaccagatgcctaaggctggttaagccgggttcataataaattataaaacccgctga

SEQ ID NO: 82689 - DNA, 443 bp, Zea mays
  unsure at all n locations
  Clone ID: LIB3114-037-P1-K1-H8
cctgaatgggtccagaagtcaagggaaatgttcaagtctgactgtgaggacatgccagcaaggcttagctttgcatggatcgcggttgagcacctggcacggattaagataaggtgccgtggagaagtgaaagtggacagcccaaggcctgttgagaggctcgcagcctacatatctgggagcatgtgagttgacgtgaagctccaagcaattgtgaagcaagaccactctgccctctttgccatgccatctgaactctgatgcatggctctgtctagtcacttctttttacgaattattacatagttgagacacagccactctataagcggctaaagcgtacgcacatttctacgaacgataatgcttttaagtctgaactgttcaatctctattactaccagaatgnttgtggacatataatataattcggggtgtctcaa

SEQ ID NO: 82690 - DNA, 83 bp, Zea mays
  Clone ID: LIB3114-038-P1-K1-A1
aaaaaaaaaatataaaaaaaaaaaaaaaaaaaaaaaaaataataaaaaataaaaaaaaaagggacggggaaaaaagttgaagg

SEQ ID NO: 82691 - DNA, 332 bp, Zea mays
  unsure at all n locations
  Clone ID: LIB3114-038-P1-K1-A10
aaaaaaaaaaaaatataaaaaaaaaaaaaaaaaaaaaaaaaaaaaaaaaaaaaaaagaaaaggaaataaaaataggggggttgcttattaatctcccctnttttttattctcatactatacctttatattattttttatttttttatccctctattttatttttactttcttcggtttttcccccttttataattttttaattttttgctcttcctttccctttctttttcttttttttatttttccaccttaatctacttttcttttatccctttttttctccccttcccttttcttgtttatactcccccttttttcccccccctttttt

SEQ ID NO: 82692 - DNA, 447 bp, Zea mays
  Clone ID: LIB3114-038-P1-K1-A2
ggtaactactcatggggaagtgaagctgttacccgcaagacccgtatcctcgacgtggtctacaatgcatcaaacaatgagcttgtgaggacacaaacccttgtgaagagtgccattgtgcaagttgatgctgccccattcaagcagtggtacctcactcactatggagttgacattggtaggaagaagaaaacccctgctgcaaagaaggataatgctgagggacaagaggttgaggcagcagctgaggaaacgaaaaagagcaaccatgtcacgaggaagcttgagaagcgcaaggagggacgtacccttgacccacacattgaggagcaatttggcagtggacggttgctggcatgcatttcttcccgccctggacagtgtggccgagctgatgggtacatccttgagggtaaagagcttgagttctacatgaagaagctacag

SEQ ID NO: 82693 - DNA, 440 bp, Zea mays
  Clone ID: LIB3114-038-P1-K1-A3
ctctaatcttattgtggtgtggtattgtgcactttgagccttgtaaaaagtgatattctgattgctccagcgtgccatcacatgcaataagtgtaggttaaaatgtctttgaatctatgctcaaattatacaaagaagtatgcccttggttataaatttatacaaatttagttggtagtctaaattctgaggcagccattttccagtagggggcttatttataactgggaaggttttagcctttgacaataaccagtttcgattttcaaccttgttatgtgaagatgtccatgttgatggcttgtgaaagcaggttcttggcctaagactgactcagatgacccttcaaagaggatggaataacaaatctaagcttctaattgttgaggatttgtctgcacggcaagtgtatgagaagctcctagaagctgtacaacctt

SEQ ID NO: 82694 - DNA, 126 bp, Zea mays
  Clone ID: LIB3114-038-P1-K1-A5
cggatcatataaatgagttactcggaaaatgttctgaaatccttacgaacagaacgttgccttcatgtttacactgtactcatgagtcacagtgatatggagatggcatagcctactattggaagt

SEQ ID NO: 82695 - DNA, 192 bp, Zea mays
  Clone ID: LIB3114-038-P1-K1-A6
aaaaaaaaataaataaaaaaaaaaaaaaaaagaaatgaaaaaaaaaaaaaacaaaacaatgaataggtgaaaacactggactggtgaagtccaaccatatggagattgcatggtctactattggtagtggcaaaaaaaaaaatttttttatgggggtccccaaatatggagggccgtggtagaggatccata

SEQ ID NO: 82696 - DNA, 298 bp, Zea mays
  Clone ID: LIB3114-038-P1-K1-A7
gtgtacagtacagtgtatggagcaagcttgggtgcttcagcccggttaatatttactatcttgtatgcttggcctcctcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggaaggcgcttaaaaggaacaaagtttactcccccgtgcatgccacataataaatttaatatagtgtaacctaaaacaaaataattggccaaggttttaaaacgtaaaaactgggaaaacc

SEQ ID NO: 82697 - DNA, 432 bp, Zea mays
  Clone ID: LIB3114-038-P1-K1-B1
gtagtttactgtgtacctctgattagaagagctgtcatattcttcgatcgtgtttagttgacttgtacaccgttcctgccgttttcctgtgataatttgtggccatcaatcagctgtgcattaataggacagcttgatcgatcgaatgcacagttagccggttagggtgtctttatgtagcactcttaatactacttaattaatacttaataccgcgacctgtttctgtctgttggaacctttatttcttcgatggttacatgagtgggggattgatcttggtcaccagcttaatcattacaattggtatctgatcaagtaattatctcctcaggtctggtctctagtgaggcggtttgatcaaccacagctttttaagcactttgtgagccggtgtgaaatgaagggcaacattgagattggcagtgtcag

SEQ ID NO: 82698 - DNA, 432 bp, Zea mays
  Clone ID: LIB3114-038-P1-K1-B10
aaataaaaataaataaaaaaaaaaacaatataaaaaaaaaaaaaaaaacaaacacaaagaaggcaaaaaaaataggggcggctctatctataacgctccattctttcctcctgcgcgcttgctttacaactgcctcttctgtggtgcccctttctttacccaacttacccgccttttatcacctcctcgtttgtttaatttgtggcgttccaaaacttattgtcctgcccgcacttccccctttcccactgtgaaacctttggatggcccccctctctgagcgtctttccaaacacttttttgcccggtatggctaatggcacgacccctttccggtcctttttttccaacggttgtctttctttatcgccctttgacccctccccttgtcggccctttttcccccgctagttttgtttttttccctccctt

SEQ ID NO: 82699 - DNA, 82 bp, Zea mays
  Clone ID: LIB3114-038-P1-K1-B11
aaaaaaaaaaaaaaaaaaaaaaaaaaaaaaaaaaaaaaaaaaaaaaaaaaaaaaaaagagaaggaaaaaaaatagggggggg

SEQ ID NO: 82700 - DNA, 412 bp, Zea mays
  Clone ID: LIB3114-038-P1-K1-B12
aaaaaaaaaaaaaaaaaaaaaaaaaaaaaaaaaaaaaaaagaaggacgatctaaagggggggagctaacttacgggtgcgtgcaaaaaaaaaaaatattttttatttaaagctgccttcattttattggccgcaggtttacaacctccggcctgggagaaccatgtcttttctaaactaacttaatttccttcccttgcccctttttttagctcgcttgatttggaaaaacccggccctgaccgaccttcctaacctttgggcactctccctttttgccggttcgcaccctcgctggagggcctcatcgcgtcggctttttaagtttctcccccctggcctgtccatttgccagcccccttcctcccgcttttaaccctggcttgcgtgggtttttctccccgttcgcccgt

SEQ ID NO: 82701 - DNA, 444 bp, Zea mays
  Clone ID: LIB3114-038-P1-K1-B2
cccccccccctttttttttttttttttttttttttttttttttttttttcacgagcataaaacgggggtaatatataaatcacgctcccaaagaagatggcgtttggcttcaattcaagacacggtaaaccagtcctgtaatagttttacgggcaaatagttcagaagtccaattcaatcaaaaagatccaacgtttagcttctgaggttcttgatggcaacatccacacttagttggcagcagcagccactcttttttggggcagcctcagtcccttctttgaagttgctcttgaaacggcgaggcacgtgtcgcatgtacctaatccttcccgtaccaggggtcttgcgcctgatggccttcacactccaattatacttgcggatgcgggccgcggggtacccgcaggaggagcaggtacttttttggaggtggaagctgcg

SEQ ID NO: 82702 - DNA, 390 bp, Zea mays
  Clone ID: LIB3114-038-P1-K1-C10
aaaaaaaaaataaaaaaaaaaaaaaaaaaaaaaaaaaaaaaaaaaaaaaaaaaaaagaagaaggaaaaaataatatgaaagggaaataaaaatacataaaatataaatttattatagtaaaatttaaataaaattacttgaaaaacattttaaaataggggggtttgtttttaatgtttcaaattttcattttccgttgctttggatttaatttttttttttttgggcccccaaaattaattaagtggcccgtttttttcaaccttggtaactggaaaacccttgggtttcccaattttattcgctttgaaacatttccttttttgccacttttgtgttttttaaaaaggacccgaccctttcttttttccaaaattttgccacctcttt

SEQ ID NO: 82703 - DNA, 418 bp, Zea mays
  Clone ID: LIB3114-038-P1-K1-C11
aaaaaaaaaaaaaaaaaaaaaaaaaaaaaaaaaaaaaaaaaaaaaaaaaaaaaaaaaaaaagagaaaaaaaaaaaaaagggaaaaaataaaacaattaaaaaaaatttacttattaaaaaaaataaaaatattattatcataacttttatttaaataaaaatggggggggttttttttgggggttctttttttcttccccttttttgccaacttttttttttttttttttttttccctcttttaaattttttcgcccttttttttccccccttgtactcttgaaaccccttgggtttccccctttttttcttttgggaacccttccctttttcccggtttgtgtttttaggaaagggtccccccctttcccctttccccaaatttcccctccttttattggaattttccccccccttt

SEQ ID NO: 82704 - DNA, 429 bp, Zea mays
  Clone ID: LIB3114-038-P1-K1-C12
aaaaaaaaaaataaaaaaaaaaaaaaaaaaaaaaaaaaaataaaaaaaaaaacaaaagaagggacaaataaaatagggaggtcatagctcttccaatttataaaccatattttctgtgccgtgccctctctttttccccgctttttctttttttccccctgccttcatctcctttttttttgtttttccttattcctctcttttggccctttttttttttccccctttattgctcatcccttgctcttccctccttttttctcctttgttttttccccggttctcccctctgtcttttcccttaagtgccccgccttttttgtttttccgcttttctccctctttctgttgtttacattctcccgcccttttgcttcccttttttccctgctttttttttttgtttcccccttctttccccttctcttt

SEQ ID NO: 82705 - DNA, 365 bp, Zea mays
  unsure at all n locations
  Clone ID: LIB3114-038-P1-K1-C3
aaataaaaataaaaaaaaaaacaaacaaaataaaaaaaaacaaactaacatacacaaaacaatgcggggaaataaaatatagtggggtgaaacctaaaatacaattcactgactcgcagatttacaacttaaaagaactgggaaaaccaaagacattacgttgcctccctttaatnnnnttgccatttctatttcccgcagtttgcgaaataaatatttttttttggccgccctaaaattaattacagggccgcggtcttaaaaacgaatggtaggaaaactcctggggctcaccaatctaatccgctttggaaaatacccccttttccaccgttgcaataaacaaaaaaagccccccccctact

SEQ ID NO: 82706 - DNA, 443 bp, Zea mays
  Clone ID: LIB3114-038-P1-K1-C5
cccacgcgtccgatcaagatgagccgtggtggtagtgccggtggtggtcaaagttctctgggttatctctttggaagcggtgagccccccaaaccagcagtggcaccagctgcaagtgctccacctgttgagaaaccatctgctgcaaagactgatgcggccaagcaggttgctgctggggttaccagccaaaccaataactaccacagggctgatggtcagaacactggcaacttccttacggaccgtccttcaaccaaggtccacgctgctcctggcggtggctcttccctgggctacctgttcggtggcaactgatgcccgtgctggtgcgctcaccaaagttatcctcccctgcctgctgcgtgctatgtctgaatcgtgaacaaccgttgtcatttcatgtgtgtaccccgtgcaatgctttgtgcgcatggttgatt

SEQ ID NO: 82707 - DNA, 59 bp, Zea mays
  Clone ID: LIB3114-038-P1-K1-C6
aaaaaaaaaaaaaaaaaaaaaaagacaaaaaaaaagaagccaaagaagatcaaaaaata

SEQ ID NO: 82708 - DNA, 60 bp, Zea mays
  Clone ID: LIB3114-038-P1-K1-C8
aaaaaaaaaaaaaaaaaaaaaaaaaaaaaaaaaaaaaaaaaaaaaaaaaaaaaaaagggg

SEQ ID NO: 82709 - DNA, 104 bp, Zea mays
  Clone ID: LIB3114-038-P1-K1-D10
aaataaaaataaataaaaaaaaaaaaaatataaaaaaaaaaaaaattacataaaagtgagggaaaaaaaataggtggtggtataatatcaccataaattcaatt

SEQ ID NO: 82710 - DNA, 71 bp, Zea mays
  Clone ID: LIB3114-038-P1-K1-D11
taggggaggcaggcttacaggcgcgtgcatgcgacctcatacctcttatatagtggcacctaaattcagtt

SEQ ID NO: 82711 - DNA, 200 bp, Zea mays
  Clone ID: LIB3114-038-P1-K1-D12
aaataaaaataaaaaaaaaagtaaaatatataaaaatatccaggctttcttactcggggatgctatttaagaggggttgtataactacaccataaattaattaactggcacttaaattacaattaactaaactgaataaaacatggctttaactaaaaaaattcttgtgttacaaattttaatttccttacattacatat

SEQ ID NO: 82712 - DNA, 267 bp, Zea mays
  Clone ID: LIB3114-038-P1-K1-D7
agaggcgagtcctacgccctagtcctactactaccctctttgtgtgctgccatccatccgtccccgctagacgatcgaggagagaataacgcagagctctgtgctcccggcctctgtcttctgccgtcccggccgtttaatttatagtctctactgtgtgttcgtcccatgtgtttagcagcagcagcaggtgtattgtgcgggtatgtaatggtattgcaactatattgggtgtaaaaccataataaatgtggaaaaaatgcaagg

SEQ ID NO: 82713 - DNA, 359 bp, Zea mays
  Clone ID: LIB3114-038-P1-K1-E1
actcccctgatctgaggccgcagcgaggagtgcccggcttgccgctgcaaagaagaaagagaagagccaccacaaccagcagcctgtgcggtgaactcccctggtctggtgtctctagaaaccttttgagctctgatgtcccctgttcgttttggacctgcaataaaacttttgagactgttttttgacatggtggaggtgccgtctgatgctcgttttgggaattaaattacatataggtacataggggttgtcttgtcgctggattctgtttggtgtaatgagctatgaactgttcgtcaatcgtcatatgaaccctgctgactatttatatggaaaatgtgggatatttgatacct

SEQ ID NO: 82714 - DNA, 75 bp, Zea mays
  Clone ID: LIB3114-038-P1-K1-E2
ttttaaaggatccaagcttacaaacccgctgcttgcaaccgaatagattttttttggggcaccctaaattaaatc

SEQ ID NO: 82715 - DNA, 137 bp, Zea mays
  Clone ID: LIB3114-038-P1-K1-E3
aaaaaaaaaaaaaaaaaaaaaaaaaaaaaaaaaaaaaaaaaaaaaaaaaaaaggcggccggggtgggggatacaacggtggcggcgcgtgcatgacaaaaacaaaactcttttatagtgtaacctaaattcaatttt

SEQ ID NO: 82716 - DNA, 117 bp, Zea mays
  Clone ID: LIB3114-038-P1-K1-E7
gtttgggtgtttccttccatcatcacttgctgaactgctctagtatttgcatttgtaattgaagtctgtcgctttaagcactcttggttctaaagatctctgtgcttttggggggtg

SEQ ID NO: 82717 - DNA, 459 bp, Zea mays
  Clone ID: LIB3114-038-P1-K1-E8
aaaaaaaaaaaaaaaaaaaaaaaaaaaaaaaaaaaaaaaaaaaaaaaaaaaaaaaaaaaaaggaaaaaaataaaaaaatggaaaaaaaaaaaaaaaaaaaaatatataaaaaaaataaaaattaaaattaaatatatttttattatacttaatttataaaaaaattatggggggctcccttttttgggttttcattttttttcccctttccttcctacttttttttttttttttttttcccccaaattttatttttttccccgttttttaccccctttttctttggaaaaccccttgtttccccccttttttccttttgaatccctcccttttttttccttttgtgttatataatgaagagccctccccttattctttttttctaaattttttttcctcttattttggatatggggacccccttttttcttctttttttcccctcgggggttttttttt

SEQ ID NO: 82718 - DNA, 361 bp, Zea mays
  Clone ID: LIB3114-038-P1-K1-F10
aaaaaaaaaaaaaaaaaaaaaaaaaaaaaaaaaaaaaaaaaaaaaaaaaaaaaaaaaggagggaaaaaaaaaaaagaggagaaaaaaaaaaaaaaagggcaaaaggtatgggggctgccggtttaaaggctccaggtttccgaccgcgtgcttgcaacataatgccttttttatagggtacccaaaattcaattaactggccgtgtttttacaacatcgggactggaaaacccctggcgttccccaattaaatcccctttaagcacatccccttttttccagttggggtaataacaaatgggccctccccaatcgcccttccaaaaaatggcaaatcctgaatggcaattgggacccccct

SEQ ID NO: 82719 - DNA, 363 bp, Zea mays
  Clone ID: LIB3114-038-P1-K1-F12
cacttctgaacctacctgaagttgccatcattgcccttgggcggattcaaaagcttcctcgcttcgatgatgacgaaaacgtttacccttcatccataatcaatgttactgttggagccgatcaccgagttgttgacggggccacggttgcaagattctgtaatgaatggaagagcctcgtggagaagccagagctgctcttgttgcatatgcgatgacccagtaatgtaccggtacatactacgacctgaaacggaggcattttggcataaaaaaataaatccatgtattcaaataaataaccaacgtggcttctctgcctggaaacagtggaaataaattgggagttattttcggagtcct

SEQ ID NO: 82720 - DNA, 367 bp, Zea mays
  Clone ID: LIB3114-038-P1-K1-F5
cccacgcgtccgtaaaaaaaaaaaaaaaaaaaaaaaaaaaaaaaaaaaaaaaaaaaaaaaagggaggggaaaaaaatttgggtgcgaaaacacccaacgcctcccctttcctgttgcttttcttttttcccttttcgctccccctctttttttttctttgttgtctcttcaaatcttattccccccccctctttactcccctttctctattttttacaacctcctcgttgctcctcctttgttcctcccctttctaatcccttttccccccttctttttttctttttttgcattttttattttttccttttatccctttttttttctttattttttttttattacctccctttattcctcttttttt

SEQ ID NO: 82721 - DNA, 443 bp, Zea mays
  Clone ID: LIB3114-038-P1-K1-F9
cagggccattccctcccagatcaaaaaaaaaaaaaaaaaaaaaaaaaaaaaaaaaaaaagagggaaaaaaaataaagagggggggaataaaaaaaaaataaattttagtggttgtagtttttatgatttagggtttcgttttggtttttttttttatttttttttttttggttttgtttgagtgaatttttttttttgttttgtgtgtatttaaatttctttttgtttggtctttttttttttttttttttttttgttttattcttgtcgttttatcccttttttctcttttttggttttaatctcccttttccctctctcgttcttttttttttcttctagcgcctctcttttttttggccttttttttgtgggcccctcctctctttttttgtttttttggcccattttcccctcccctctctttttttctgtttcctctt

SEQ ID NO: 82722 - DNA, 307 bp, Zea mays
  Clone ID: LIB3114-038-P1-K1-G12
aaaaaaaaaaaaaaaaaaaaaaaaaaaaaaaaaaaaaaaaaaaaaaaaaaaacaaaaaaagggcgaacaataatgggaagggccggcctctttaatggtgccagctataccaacgctttcttgcagcgtcataaatattcaatggtgtgacctaaattcaatacactggccgctgttaaaaccgtggggaccggaaaaaccttgctgtgacccaaattaatcgtcttgcagcaaatgccctttccaacagttgccgtaatggcgaggaggcccacaccgatcctccttcacaacattaaggcaccct

SEQ ID NO: 82723 - DNA, 424 bp, Zea mays
  unsure at all n locations
  Clone ID: LIB3114-038-P1-K1-G3
cgtagcgatggtggccggccggtgacgtgagcgacccaaagccgaaagctgattcgatctagactaagctaatacagcctacaagagggaggaagagaggccctacccgtggaattaagtcattagtttgtggtccaattcaataagaaagtaaatgtggtgtgtgaagatggtatggcattatcagtctttaatcccatattatacatttagatagaagaaaatcaacttatatgtggtagtgttccctactttttatatgagataaataaagggatacggagaatgctgcncgcnnaaaaaaaaaaaaaaaannnnntnaaataaaaaaatataaataaaaaaaaaaataaatatataataatttatttaatttaattataaaaaataaaataaaaaggggggccgttttaaaggaaccaag

SEQ ID NO: 82724 - DNA, 291 bp, Zea mays
  Clone ID: LIB3114-038-P1-K1-G4
aataacaacagtgtgccgatcggtgacgtgagctacccaaagcctaaagctgattcgatctagacgtaagctaatacagcctagaagagggaggatgagaggccctacccgtggaattaagtcattagtttgtggtccaattcaataagaaaggtaatgtggtgtgtgaagatggtatggcattatcaggctttaatcccttattatacatttagatagaagaaactcaacttatatgtggtagtgttccctactttttatatgagacatataaagggatacttgtaaatg

SEQ ID NO: 82725 - DNA, 356 bp, Zea mays
  Clone ID: LIB3114-038-P1-K1-G7
gaaaaaaagaaaaaaatgaaaaaaaaaaaaaggaaaataaaaaaaaagaaaaaaaaaaggggaaataaaaataaaggggtggacaaaataaaaaatacacacatcacttctactttacctttaaaaaatcttaatcatcacaacactctattttattacattataaactctcttttaaatcctatcgggcccgcctcttaagaggccccagtcttctctccctctttctgaccttcattccttttttattgggtccccccttatttaaccccgcgcccctctttttccaccctcttccgtggaaataccctttgcgatcccctattttttccttttggtcacattccctctttccc

SEQ ID NO: 82726 - DNA, 204 bp, Zea mays
  Clone ID: LIB3114-038-P1-K1-H11
aaaaaaaaaaaaaaaaaaaaaaaaaaaaaaaaaaaaaaaaaaaaaaaaaaaaaaaaaaaaagaaaaaaaaaaaggggggaaaaaaaaaaaaaaaaaaaaaaaaaaaaaagaaagaggggggggccgttttaagggatccaagcttacttccgcttccttgcaacgtcatactttttttatggggccaccaaaatcaaattcatg

SEQ ID NO: 82727 - DNA, 332 bp, Zea mays
  Clone ID: LIB3114-038-P1-K1-H2
cggacgcgtgggcggacgcgtggggactagttctatatacggtttgttgcaaaaaaaagggtagggaaaaaaaaaaaggagggagaaaaaaaaaataaaataaaaaaaaaaaaaaaaaatacattataatttataaaattaataaaataattattaggggcggctcgttttaaggttccttttttacttcctcgtgcttgctatgtttaagtttttcttttgtgtttcctaaataatatatcttggcctttttttaacatcgtcgggcttggaaaaaccctggggtttcctattttaatcgtctgggtgaaaatccccctttctccggttgg

SEQ ID NO: 82728 - DNA, 226 bp, Zea mays
  Clone ID: LIB3114-038-P1-K1-H3
aaaaaaaaatataacaaaaataaaacaccaaatttactaccaaatctaaatccacaaaactggacagggtcataaataaaaaggtgaggaactggctcactccttttaaactatccacccttccctccccttccatcctaacacctaccttcttttatagcgtctcctaaatccaatttacttcccctcgtttcacaccctcctaattgcaaaaaccttgctttcc

SEQ ID NO: 82729 - DNA, 321 bp, Zea mays
  Clone ID: LIB3114-038-P1-K1-H4
aaaaaaaactagttctagaatcgagaactaacaatctagaggatccaaaaaaaaaaaaaacggaaagggaaaataaaaaaggtggtgtataataaaaaaataaaacttatacattcggaaaataaataattaaaatttttaggggggcgtctctttaaatgaacttaatttttctttaccttgtatttcaactttatattttttttttggtgccccctaattaaatttaattggccgggtttttaaaacgtggggctgggaaaaaccttgggttcccccaatttaatccctttaaaaaaaatcccttttttccgaggtggg

SEQ ID NO: 82730 - DNA, 336 bp, Zea mays
  Clone ID: LIB3114-038-P1-K1-H5
gcctgcggtaccggtctccaatttccggccccgcctccgcgtccgaaaaaaaaatttttaaaaaaaaaaaaaaaaaaaaaaaaaaaaagatatccatccgggtcggggataataaaaaaggcgggtacaaaaaacacccaaatatcaactcctttactaacctctacttcaattttttccctttctcaacccttgggtgtccctttttaagactcccttctttcccccccctttttccccacttgctcctttcttttttgttcccccccctctaatttctccccccggcttctcccccctcccttcccccttaaccccccttttctctccccccct

SEQ ID NO: 82731 - DNA, 436 bp, Zea mays
  Clone ID: LIB3114-038-P1-K1-H7
aaaaaaaaaaaaaaaaaaaaaaaaaaaaaaaaaaaaaaaaaaaaaaaaattaaaaaaagggggaaaataaaacgggcggtgtataggtttccattctttctttccctttcattcatcttattatcttttctatattgtcccctcaaactcaatttattgtccttcgtttccctccatccactttgggtaacctcttatattccccactttattcaccttgctttccttccccctttttccagttggcgttcttccccattagcccccctccgatcgcccttcctacctgtttctcatctggaattttctttgtaacgttcctttttatgtctcttttagcgcctctccttttgtggttacccccacctccgccgatttcctttccttctcttttttcccctctcttttccctttttcccttcttttctttcttttt

SEQ ID NO: 82732 - DNA, 86 bp, Zea mays
  Clone ID: LIB3114-038-P1-K1-H9
aaaaaaaaaaaatataaaaaaaccaaactaacatacaaaaaacatacaacaaaatgggtatggtataatgagacggggggacaatt

SEQ ID NO: 82733 - DNA, 131 bp, Zea mays
  Clone ID: LIB3114-039-P1-K1-A1
ccacctattttcattaaacctctctatctgccagttcctacctctctatagggtggacaggcgtattgcttatttaatgctggctgttttaagaacctgaaatggacaaaggaattcaatcaagtgtttac

SEQ ID NO: 82734 - DNA, 229 bp, Zea mays
  Clone ID: LIB3114-039-P1-K1-A10
aaaaaaaaatgaccaaaaaatataacaaaatgcagctgtaagtttactgctgctctctaagtcgtgttcagtcatccagtgtgtctagtctagggaaaccccataaaaatggtgaaggtggaatcccatcccagtgtcataattaaggatgcacttcttctgtaagcaaatgtatgatgtacaatggccggccggcagtctaaatgttacaactagctcttcttggtga

SEQ ID NO: 82735 - DNA, 264 bp, Zea mays
  Clone ID: LIB3114-039-P1-K1-A11
gactagttctgacccgcgagcggccgctctgcaggagccaagctaccgtacgcgtgcaagcgacgtcatatctttcatatagtgtaacctaaatacacttcactgacctggtgaatacaacatcctgtctgagaaaactatgtcatgacgcaccttaattgtctggcaatgcatgatgttcatcgcaggtgcggtagtataaaagagacaagtacctatcgtcgttgcaaacaaatgcacaacctggctggcgattgagacgct

SEQ ID NO: 82736 - DNA, 245 bp, Zea mays
  Clone ID: LIB3114-039-P1-K1-A3
taaaaaaaaaaaaaaaaaaaaaaaaaaaaaatttttaaaatttaaaaaaaaaaaatatcaagaggtttagaaaaatttaaaattatttacacttcacatcctccctctttaactattttataatatcacctaattattattctactgcctgtccttttttaacgtctccaatttttaaaaccttggctttccaccaatttatttttttttttgggacattcaattttattcacctgccctttttt

SEQ ID NO: 82737 - DNA, 193 bp, Zea mays
  Clone ID: LIB3114-039-P1-K1-A4
agctaggacttcatcctatcttggttgttgcctgatactgcattttcttaccataagttgcaacctcgtttcttgcggtttggtgtaagacacgacttttctgttaataatgttgtaggcttgaactttccaggctgtggagattggggaaaactcagcgctgataccatttgttacttttctgtttcttgtc

SEQ ID NO: 82738 - DNA, 230 bp, Zea mays
  Clone ID: LIB3114-039-P1-K1-A5
agctttctctctctctcccctctagttttccttgtcgtcttgtttctcccagttcggtgagtggttagtgtgacgatgaagaagaagatgatgatggcgtcccagtgattaacccgtgcggtaatgtgatagaagaagtcgtaggctgtctccgctcctcccttcctccctagctcaggattcttttgtagcttgggtttattctcatctgcttcgatcgctcttcgatg

SEQ ID NO: 82739 - DNA, 328 bp, Zea mays
  Clone ID: LIB3114-039-P1-K1-A7
cccttcgttcaataaatatacgacgccgccaaaaaaaaaaaaaaaaaaaaaaaaaaaaaggaaaaaaagggaaaacaattataaaaaaaaaaaacttaaatacaaaagcataaaaaaaaaaaaaatatataataaaaataaaaaaaaagggggggccgttttaaaggttttaacacttgcttacactgggtaaaaccctcaattgttttctatttggtggacttaaatcaaattcccttttccccagttaaaaacaatggccaatgggaaacccctcgtgcaccctaactaaaactgtttgaccaaattcccttttgggaagccgcct

SEQ ID NO: 82740 - DNA, 97 bp, Zea mays
  unsure at all n locations
  Clone ID: LIB3114-039-P1-K1-A8
aaacccgccgcgacccacacatcctcccttctttcaataaatatactactccgncctttaaaaaaaacaaaaaaaaaaaaacaaagaaattttttta

SEQ ID NO: 82741 - DNA, 190 bp, Zea mays
  Clone ID: LIB3114-039-P1-K1-B1
aaaaaaaaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaaaaaaagggggcggccgttttaaaggatccaagcttacttccccgtgcatgcaacgtaatagcttttttatagggccacctaaattaaatt

SEQ ID NO: 82742 - DNA, 349 bp, Zea mays
  Clone ID: LIB3114-039-P1-K1-B3
gagtctccgtctccggtcggaggtccgttgccgccgccttgcgggaccgggacgacgcgtcgtgcctcgacgatttgctggtcccgtagcctctgttcttcacctggatcaccaggtggtggaggagcgccaccagctccagcatgtagtgctcggttttcgccttgtcggcgtgatggagcgtctggatgcgggtgacgctgtgctgggagcctgatttcttgctcatgtcgctcctgcgagcaaggtggatgcatgttaggtggtgctgcaactgcaagcaaaacatgttacgctacattgtcgatggggagatcataataaggtttatcaacggtcgcatgggaaa

SEQ ID NO: 82743 - DNA, 79 bp, Zea mays
  Clone ID: LIB3114-039-P1-K1-B7
aaaaaaaaaaaaaaaaaaaaaaaaaaaaaaaaaaaaaaaaaaaaaaaaaaaaaggaaaaaggaaaaaaaaaaaaaaaaa

SEQ ID NO: 82744 - DNA, 65 bp, Zea mays
  Clone ID: LIB3114-039-P1-K1-B8
cccacgcgtccgaaaaaaaaaaaaaaacttctataaaaaaacaaaaatttaaaaaggatatcgtt

SEQ ID NO: 82745 - DNA, 430 bp, Zea mays
  Clone ID: LIB3114-039-P1-K1-B9
agaaaaagagctaaaagcaatacagtacttggagagaagagagtgtgagtacgaccagaaaatatccattgatttctacaaggaaggagatcccttgaaaccagctgtgacgggcgtcttagtgttcgtttccactccagatccaattggcaacaagtactatcttggccctgctcctctgcaggatatggcaaggcaaattgctacagccaatggccctactggctataatagggattacctgttctcaatggagaaggcattagccagcattagccacgaagatgattcgatcatagagcttgcaaacgaggtgaggaaggtgctcaacagaacaaaggagaccaagatcactggtgccaatgcttccatgaaatcacatgcccctcttgtgcacctgtccgcgctttcagaaggcaccgttgtggac

SEQ ID NO: 82746 - DNA, 68 bp, Zea mays
  Clone ID: LIB3114-039-P1-K1-C10
taaaaaaaaaaaaaaaaaaaaaaaaaaaaaaaaaaaaaaaaaaaaaaataaaagggaaaaggggaatt

SEQ ID NO: 82747 - DNA, 264 bp, Zea mays
  Clone ID: LIB3114-039-P1-K1-C11
agattcatggtttctgagcaaccgccgggtccatagcaaaccaaccctgcatgcagggccagcttattatatataatatctgaggtggagcatatctatctggctgtgtactgcaagcaggcctagtacgccgcctgcgcgttcctcctattacacatataggcccctccctgcgtgtatgcttgttaccgtcgtgtcgaaccttgtactacgaggctccatcgaacatcgatggcttgcttctttatcagaacatgtttgaat

SEQ ID NO: 82748 - DNA, 352 bp, Zea mays
  Clone ID: LIB3114-039-P1-K1-C3
cacgactgaagtgaagtgccgggagcacgccgaggccaagcatcccaagacagacgtgtaccagtgcttcccccatctgaagaagtgaaaggcctgaacttagcaaccagtgctggtttggtcactacgatcgggccagggggcgttccttgtgttgagggtgttcattccgtgttatcttcccgtcagtcatgcgtcctgtcctatgttaacctacataagaaagcgatgtggtgtccacttctagtgaaactactgtctgctgttaaaacctggttggtttcagaacgatgattttcgtgtgcaaaacagattactggtccgtgggagttgggccagtttgcattgtctt

SEQ ID NO: 82749 - DNA, 195 bp, Zea mays
  Clone ID: LIB3114-039-P1-K1-C5
ctacctagctcccatccccatgcatgtataaacgagataaacgagctctgtgattttatagatggaaaattttcaccgtggttgatgttttgcgattgctagctcgctgaggctgcaatcctctgtaaatatatcactgttgtcatcgtttctatacatcgatgatcaccgtaattgattcgattatttaggttt

SEQ ID NO: 82750 - DNA, 366 bp, Zea mays
  Clone ID: LIB3114-039-P1-K1-C9
ttaaagaaggaagaaggcttccccctgtttgctgacgcctcattcttcttttgtggtgcctaaaattaattttctgggcggcgttgtacaacaactttgactggtaaaaaaccgctgtcacccaacatattattcttgtagcacaacctccttttttcggctggcgccataacaaataggaggcgagcgctgttcctttttaacaactggtcagccttaaaaatgaatagtacacccccccctatagtgcattaaccacgacgggggttgtggttacacgcaacaggaccgtttctatttttagcatcctataacccgccccttttacagtctttccttctcttttttgttacattctctggcttt

SEQ ID NO: 82751 - DNA, 342 bp, Zea mays
  Clone ID: LIB3114-039-P1-K1-D10
aaaaaaaaaaaaaaaaaaaaaaaaaaaaaaaaaaaaaaaaaaaaaaaaaaaaaaaaaaaagggaaaaaaaaaaaaaaggggggccggtttaggggggcgcccgttataaaggatccaagctcaagtacgcagccttgcaatagcttaactttaatatagtgtactcgaaatccatttcaatggccgtaattgaacaactcctggactggcaaaacttaggcgtttcccaacttaatccccttgcaccacatgcccttttagccaaaaggcctaaaaggaaaaacgctcccaaccaatcgcccttccaaacagttgaaaagcccgaatggtaaaggggaccct

SEQ ID NO: 82752 - DNA, 370 bp, Zea mays
  Clone ID: LIB3114-039-P1-K1-D6
taaaaaaaaaaaaaaaaaaaaaaaaaaaaaaaaaaaaaaaaaaaaaaaaaaaaaaaaataaggaaaaaggcaaaataaagaacacaggcttacaacagtcacaactcatataaaaaagtacgggggggtccttttagaggtccctggttttccaccttttttactggccttacctttttttttttggggctccttaaactaaattcacggccccgattttcccaccgtcgcaataggaaaaaccttggcatcacccaccttatccacctggtgtccaatcccctttgcgcccggtacgttttatggaaaaagcccttaaccgatcctttttccaaaattgcgcccaccttaaccggcaaatgtacccccc

SEQ ID NO: 82753 - DNA, 355 bp, Zea mays
  unsure at all n locations
  Clone ID: LIB3114-039-P1-K1-D7
ctcgagttcaggtcctctgagagtagggagagctggactggacaaagagagggggctgtcaacaggcagctcaagtgagcacgttgggctacaaaggtttagaattgattcagaatagtcagcctgcatcctgcaagcagcttatcatgattgggagtgcagaactagacttcttcggaagcttaaactagacttcgcacagattttttgtacagttctagagatgtgtagatgcctttaggaaaaagaggtgtacacaagcgagtttttcagctttaatcccccacggtccgtaataggttttgccgttgcagcacgttcnaaaaaaaaaaaataaattttttttttctattta

SEQ ID NO: 82754 - DNA, 87 bp, Zea mays
  Clone ID: LIB3114-039-P1-K1-E1
taaaaaaaaaaaaaaaaaaaaaaaaaaaaaaaaaaaaaaaaaaaaatatataaaaaattcaaggggaaaaactcaaacaatgaaaaa

SEQ ID NO: 82755 - DNA, 214 bp, Zea mays
  Clone ID: LIB3114-039-P1-K1-E2
taaaaaaaaaaaaaataaaataaaaaaaaataaaaaaaattaaaaaaaaaaaaatttataagagaaaaggggaaaaattaaaaaaaaaacaatttaaactacataattccggcccttctttccctatttttaattctctgaaggggtttatccctggcgttttttttcatatggccgcgcccgtggaatcccccccgtcttcctttttaaacct

SEQ ID NO: 82756 - DNA, 418 bp, Zea mays
  Clone ID: LIB3114-039-P1-K1-E5
taaaaaaaaaaaaaaaaaaaaaaaaaaaaaaaaaaaaaaaaaaaaaaaaaaaaaaaaaaaaggaaaaaagaaaaaaaagggggcggccgttctaaaagagaaccaagggggcgcccccttgcaggccccgggttatctttctctatagtggcacctaaatacatttttttggggggcccataacaaaagtccagggggggaaatttttaacggtccccactggaaaaacctgggggtacaccaccttattgccctgggaggaaatccccatttggccagctcggttaatccttacaaacccttgcccatcctccctggcaaaagggaccccacctggaacggcgaatgaaacccgccctgtgggggtgcttcaagcgcggggagcggggcggttccccccaccttaaccccttctttt

SEQ ID NO: 82757 - DNA, 306 bp, Zea mays
  Clone ID: LIB3114-039-P1-K1-E6
ggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaa

SEQ ID NO: 82758 - DNA, 209 bp, Zea mays
  Clone ID: LIB3114-039-P1-K1-E7
cgaaagcacgtacggccgcgtgcctggtctagctacgcggccggttgatcttgagcagttaagcgtgtacgaaacgacagcgctgtgtacgtgtactgtctgctgaagtgtgagatgtactgtctgtgtgtatttggtatggatccgatcggcctgatgtatgaaaaggatgtttacgtactatataaagatggaaaatcgtatttgcc

SEQ ID NO: 82759 - DNA, 429 bp, Zea mays
  Clone ID: LIB3114-039-P1-K1-F1
gttctacggaacctggtgtggttcatgcagggctctctttccaaggctctgccggacagctttggagacccctgatgtattgtttctaaaagtgaattttgatgaaaacaaacccatgtgcaaacgactgaatgtcaaagtccttcctttcttccatttttaccgtggagctgatgggctactggaggctttctcctgttccttagctaagtttcagaagctgaaggatgccgttgcaatgcacaacacggctcgttgcagcattggtccacctgttggagttggcgatgttgacttgctggatagcacgagccctcaagagaaacctgcagaagctagcccacattagattaatgagaaggagctcctccccatccacgtctacatcctgctcattgttttcttcactatagaccttaatgtaatcag

SEQ ID NO: 82760 - DNA, 177 bp, Zea mays
  Clone ID: LIB3114-039-P1-K1-F11
cgcccttttcaacaaaaaaaaaaaaaaaaaaaaaaaaaaaaaaaaaaaaaacagaaaaagggaaaaaaagggccgcgcggtataaaaaatccaggctttcgttctctaggatgccacgttttacctccgctattgtgccacctaatttcttttctatggccaccctaatacaatttc

SEQ ID NO: 82761 - DNA, 354 bp, Zea mays
  Clone ID: LIB3114-039-P1-K1-F12
ggttaccaaaaaaaaaaaaaaaaaaaaaaaaaaaaaaaaaaaaaaaaaaaaaaaaaaaagggggaccggtctaaaaagatccaaatttacaaacccttccatcccaaattaatagctcttctatatatgaaaacctaagggcggttcattgaaaggacctatcacaacttcccgactgtgaaaaccctaacttttcctaatttaaccccttaataaaatatcccgctttcgttttttaagcgtattagcctaagaaaacccttagcgttcccccttttaacctttttaacaaacatccccttttatgggactcgcgttataccgaaaaatcccccccctatccccttttcaaaa

SEQ ID NO: 82762 - DNA, 252 bp, Zea mays
  Clone ID: LIB3114-039-P1-K1-F3
agatgacggtgagtttgaggaagttttcatcgctaggccggaggatttcatgtcatcatcatgataaagattagtccatcatttctacaaagggaccactgcgcgttcttggagtggaccgtcgctctatgctggttcttctagaatctgggatgtggcttgcttgtccctttgggaggaaaaagaaaatcttttatgtgagatcccaaacaaccgttgtggatgatattaagctttgatttgacgctccaa

SEQ ID NO: 82763 - DNA, 422 bp, Zea mays
  Clone ID: LIB3114-039-P1-K1-F7
gggaggcgcagtgggccaccgcgcagaggacgctgcacgggctccagccgccggaggcttcctccaacacgctgttcaacgacaagagcagctaccgcgagctgtccgagatcgccgagcaggccaagagacgagctgagatcgcgaggctgagggagctcaacaccctcaagggccacgtggagtcggtggtcaagctcaagggcctggacatcgacaccatccagcagaactacacggtgtgagagcccctctgctgcgatgtcgacgacaacacctttgctgcccgacgggagccatctgattacagataaaaattttcctagctgtaaagctctctataccaccagatactgccatatgatggtatggttgggtacccgtctttctagggaggttcttttctctctctcttttcttat

SEQ ID NO: 82764 - DNA, 55 bp, Zea mays
  unsure at all n locations
  Clone ID: LIB3114-039-P1-K1-F8
naaaaaaaaaatatatataaaataaaaaatttattaaaaatataaaaatattttt

SEQ ID NO: 82765 - DNA, 331 bp, Zea mays
  Clone ID: LIB3114-039-P1-K1-G1
aaaaaaaaaacaaaaaataaaaaaaaaaaaaaaaaaaaaaaaaaaaaaaaaaaaaaaaaaggagataaaaggacaaaagaaaacaaacgcttccatacaaaaaagggggggccgttttaaaggacccaagtttacttacccgggcaggcaaggtaataccttttttatagggaaacctaatttaaatccattaggccgttttttaacaacttcgggacaggaaaaaccctgccgtcacccacctaaatggcttggcagaacatccccttttcccaagctgggttaaaacaaaaaaggcccaccccgatcgcctttccaaacaaatgcccac

SEQ ID NO: 82766 - DNA, 188 bp, Zea mays
  Clone ID: LIB3114-039-P1-K1-G3
tccacatgctcgcgcccaactggaaatctcccgacgaggaggaggaacaggaactaagcgtgatccgggagagctgaaccgagaggtacaagcaaagtctggttgagagataaggactctgggaccctctgaacatgctgtcaagcaacatgtactactagcggtgtgaacgggtggtgtgaacactc

SEQ ID NO: 82767 - DNA, 76 bp, Zea mays
  Clone ID: LIB3114-039-P1-K1-G4
tttttctcgcctctcttttcccttctctcctcttttctcctctttctctctttttctcctttcttctcatttctct

SEQ ID NO: 82768 - DNA, 178 bp, Zea mays
  Clone ID: LIB3114-039-P1-K1-G5
taaaaaaaaaaaataattttaaataaaaaaaaacaattttaaaaaaaaaaaaatttacttacgctttcaggacgccgccaaatacgggctttggtgtccccccctttaaaagatctacggtgtctttcaaattcatgcaatgggaaaacttttttttacggccacctaaattaaattc

SEQ ID NO: 82769 - DNA, 266 bp, Zea mays
  unsure at all n locations
  Clone ID: LIB3114-039-P1-K1-G8
tntnaaactaaaaaaaaaaaaaaagggcggtcgatctagaggatccaaacggggcgtccgcgtgcatgcgacggcttacctcctctatcctgtcacctaaattcatttcactggccggagctatacaacattcagaccgcgaaaaccacgacgtacccatcggaaacaccttgcagtacatcaacttattgtcagctgacgacataccgaataggcccgcaccggtcgtccttaccagcacttgaccaatcggaatggccaacggg

SEQ ID NO: 82770 - DNA, 225 bp, Zea mays
  Clone ID: LIB3114-039-P1-K1-G9
ggttcgggtactgagcgaccggcggagagcagagcagcggatggagcttttgcgttgtgtagtgtgtcagtggtgatgtccgcacgtgtagtactgtagtgatctgggattagcaggaactgagcaaatattggttggttgtgtgtttgttggacgacgaagtgtttctgttaaaaaaggtcttgatgccttaactttaattcagcttctatctttaaaataaaa

SEQ ID NO: 82771 - DNA, 439 bp, Zea mays
  Clone ID: LIB3114-039-P1-K1-H12
gaactagttcgtcgtatagacgaacctgtttccaagcacattgaagagcaaggattagagtttcttcagtttgccttccgctggttcaactgccttctgatacgagaggtacctttccatctcgtaacgcgcctgtgggatacataccttgccgaaggcgactatctgccagattttctcgtgtacatatcggctagttttttgctgacgtggtcggacaagctgcagaagctggattttcaagagatggtgatgttcctgcagcacctccccacgaggacctgggcgcaccacgagctggagatggtcctctcgagggcatacatgtggcacacgatgttcaaaagctctcccagccacctcgccggctaggacccacccaagtccaccatgcctgtaagcggcagtcagttccttttgttttttttttggtaagcgc

SEQ ID NO: 82772 - DNA, 440 bp, Zea mays
  Clone ID: LIB3114-039-P1-K1-H3
gcctcatcgacgagtacaagttgaagggccatatccggtggatctcggcgcagatgaaccgcgtccgcaacggggagctgtaccgctacatttgcgatacgaagggcgcattcgtgcagcctgcgttctacgaagcgttcggcctgactgtgatcgagtccatgacgtgcggtctgccaacgatcgcgacctgccatggtggccctgctgagatcatcgtggacggagtatctggcctgcacattgacccttaccacagcgacaaggccgcggatatcctggtcaacttctttgacaaatgcaaggcagatccgagctactgggacaagatctcacagggcggtctgcagagaatctatgagaagtacacctggaagctctactccgagaggctgatgaccctgaccggcgtgtacgggttctggaagtacgtgagcaac

SEQ ID NO: 82773 - DNA, 463 bp, Zea mays
  Clone ID: LIB3114-039-P1-K1-H5
taaaaaaaaaattattttttataaaaaaaaaaaaaaaaaaaaaaaaaaaaactttatttatcagaaaacaagggaaacataaaaacaataaagggcttcacatttttctttaaactttaatttcaattgtctcccacacttttcttaccatttccctttacttataaaaatcctttaattaaaataaattgggccgcccttttacaaattcccctatttatcaacctcccttttttttgaccaaatattctttttttttttgccccccccaacttttacccctccccctctttttaacacccccttttctgaaaccccctctccctccccccttttattctgtttgcgaacttccccccttctccacctggcctttaactcaaaaggccccccccgtacccctcttcctaatttttccccttccttattgcctatcccccccccccttttctccccctttttc

SEQ ID NO: 82774 - DNA, 347 bp, Zea mays
  Clone ID: LIB3114-040-P1-K1-A1
aaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaagggggcccccctttaaagaacccaaaattttacacccgtttgtttgaaataaaaaattttttttatgggcccccaaaaataaaatccagggcccggttttaaaaaacgtcgacagagaaaaacctgtggtttcccaaattaaaatttttgtaaaaaaaatccctttttcaagagggggaataacaaaaaaaagccccacaaaaatctctttccaaaaaattgccacacctaaaaggaaaa

SEQ ID NO: 82775 - DNA, 59 bp, Zea mays
  Clone ID: LIB3114-040-P1-K1-A2
ccggtccggtaattcccggagtcgacccacgcgtaccgttaaaggaacgatcagctatt

SEQ ID NO: 82776 - DNA, 145 bp, Zea mays
  Clone ID: LIB3114-040-P1-K1-A5
aaaaaaaaaaaaaaaaaaaaaaaaaaaaaaaaaaaaaaaaaaaaaaaaaaaaaaaaaaaggggggggctttaataagatgcgagagtgccaacacatgcatacgacacaataccttcttttttagggtcacctaaatttaatttt

SEQ ID NO: 82777 - DNA, 158 bp, Zea mays
  Clone ID: LIB3114-040-P1-K1-A7
ggacgatcagctattcaggtggataggttagcttaccgatgagctctcgctttcgagtgactggtgaaggaaatggacctcgcacaccgcattttcgctatgcattctgaaaatgtaccgtgtggttttgtacatatggcatcagtaggcattatatc

SEQ ID NO: 82778 - DNA, 288 bp, Zea mays
  Clone ID: LIB3114-040-P1-K1-B11
atccagcccgcggactactgcctgatcacgagcatccgctagacactcacgcacggtccggtctcacgaaaggattgagactctatttgtatatgcacgtatatatccacatcaatgtatttcaatttacgtgtgttaaagtggattacacgaaaggaatcgctgcataataggtttgcagcggatcactgttcgtgtgctggagaataatacgaaaaggacgtgagacatatctatcttttacaaaaaaacaaactagggcgggcgttctacaggatccaagcttac

SEQ ID NO: 82779 - DNA, 433 bp, Zea mays
  Clone ID: LIB3114-040-P1-K1-B12
caaggctaatgatggagatccatcttcgaatgaaactgagccatcaaatggaaagactgatatcaatgatacacctatggatgaatctcaggcaacagatgaggatggtcgagattctggtaaaaacggcggtggaacagacctaaatttgaatttaggtttgaaagacccggatggtgataatgaagttgagacatcagagaaacatgtagcggcaaacaatccgcagacagagaatagatccaagaggaaatccgtaacccctgaccttgagatgacaatgtaacccagaaatttcatttgtcttaattttactatttgccatgagcccatgaggtgtgtaacttgggtacgttctcatcgtaaaaacatttaagtaaaatcgattacaggacatacaatagtgtgaactgaagaaacctttttttactcg

SEQ ID NO: 82780 - DNA, 330 bp, Zea mays
  Clone ID: LIB3114-040-P1-K1-B4
ctcagttaacctgtgtccgccagatgataactaagacatttaaactggcaactggctgaactattgtttttcgctggattcactaaacatgtacgcagtccatttcgttgggttgggtttgctgcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcggccgttttaaaggatccaagtttacttacccgtgcatgcaacgtaatagtttttttatagggccaccaaaattaaatt

SEQ ID NO: 82781 - DNA, 275 bp, Zea mays
  Clone ID: LIB3114-040-P1-K1-B5
taaaaaaaaaaatatataaaaaaaacaaaaaaaaaaaaaaaaaaaaaacaaaatttataagaacgggggtaaaaaacaagggaggagtaaatttacggcccttcttttgagtcgcctaagttttctttcctggccatcgggttccctctttttttttgtgaattccttgacttttttcacgtgccttttttttccacttatttttcctgtaaaaactttgccttctcccttttttccccccttgggatcacccttcctttcggccggctcccttt

SEQ ID NO: 82782 - DNA, 191 bp, Zea mays
  Clone ID: LIB3114-040-P1-K1-B7
aaaaaaaaaaaaaaaaaaaaaaaaaaaaaaaaaaaaaacactaactttccatctcggaaggagcaacatcataggggaaggaatagcgtcacactaaattcaatgtacctgtccgtaccttatataactgtcgagactgttaaatcccttaccttacttaatttaatgccatgcaaccctctccccttttt

SEQ ID NO: 82783 - DNA, 293 bp, Zea mays
  Clone ID: LIB3114-040-P1-K1-C10
aaaaaaaaaaaagggggggttttttttttggggggaaaaaaaaatttaaaaaaaaaaaaaaaaaggggggggccttttaaaaaaaaaaaaatttccccccgggggggggaaaaaaatattttttttaagggggccccaaaaaaaaaaacccgggggcggggttaaaaagcgggggggaaaaaaaacccggggggcccccaaaaaaaaggtggtggaaaaaaaccccttttttggggggggggaaaaaaaaaaaagggcccccccctttccctttttaaaaatgggggcccccc

SEQ ID NO: 82784 - DNA, 91 bp, Zea mays
  Clone ID: LIB3114-040-P1-K1-C11
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 82785 - DNA, 187 bp, Zea mays
  Clone ID: LIB3114-040-P1-K1-C12
gacaaggatatagagaatatattagtactagatatatgtagctgatcaaagacaaacaatgcctctctctagaaagagacaaggatatagagaatatattagtactagatatatgtagctgatcaaagacaaactgtataacgcatgtcaattattttcattcatacatgatacatgaggttgaaaa

SEQ ID NO: 82786 - DNA, 212 bp, Zea mays
  Clone ID: LIB3114-040-P1-K1-C7
gcagcagcaagcggccccggctggtgtggacgccgcagctgcacaagcggttcgtggacgtggtggcgcacctggggatgaaaaaaccggtgcccaaaaacatcatgcaacttattaacgtggaaaggcttacgcgggaaaacctggccagccacctgcagaagtaccgcctttacgtcaagcggatgcagggcctcttcgacgagggcccg

SEQ ID NO: 82787 - DNA, 383 bp, Zea mays
  Clone ID: LIB3114-040-P1-K1-C8
taaaaaaaaaaaaaaaaaaaaaaaaaaaaaaaaaaaaaaaaaaaaaaaaaaaaaaggggggggtgttttaagagggggggcttactaacgcgattctttcaaaccaagatctctcttattgtgtgtccaaagttaaatccactgtccgtggctctacaacttcttgtctggcaactctttgtcctgccccaacttaatctttttgcagcgcatcccctttcgaaccgctggtgataccatcaagagccccgccgcaaacccccttccattcagttcccatgtctaaatcgataaggacccgcgcactggccttccacattaacttctccatgtgtggaggatactcacagcgccagtgaactccttcccatccccctaccaac

SEQ ID NO: 82788 - DNA, 417 bp, Zea mays
  Clone ID: LIB3114-040-P1-K1-C9
cccacgcgtccgaaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaaaaaaggggggggccgttttaagggatccaagtttacttccgggggcttgcgacgtaatagtttttttttgggggccccaaaattaaattcatgggccggggttttaaaacgtggggatgggaaaaaccttggggttcccaaattaaatggctttggaaaaaatcccctttttgccagttggggtaatagcaaaaaggcccgccccgatcgcctttccaaaaatttgcccaccctaaatggaaaaggggaccccccctttaacgggcctttaaacgcgggg

SEQ ID NO: 82789 - DNA, 443 bp, Zea mays
  Clone ID: LIB3114-040-P1-K1-D1
aacaagaccttcaccctaacaccccagcagtacattgtgaagctggagcaaggaggccaaaccgtctgcatcagtgggttcatggcgtatgacgtgccaccgccgcgtggtcctctctggattcttggggacgtcttcatgggagcttaccacacggtgttcgacttcggcaacgacaggattggcttcgcggaatctgcatgagtgtggagagcactctcatctttataaagacgataccctatgtattagggatgtgtagtttactgtctatccactacatgccaacagtacgctgcaaataaatcggtggccaaaattgctgaaaccagaaacgtgaacagtactgctttctttgtttctggagaagagcaaatggatgcttcaagacatgcatgtccgatgtgtattgagaaatagagcgacgagtgctgctcgatcgt

SEQ ID NO: 82790 - DNA, 270 bp, Zea mays
  Clone ID: LIB3114-040-P1-K1-D2
ctgaaggctgtcgtcgttcaagcaaaactaccaaatcgagttgtgatgtggttttaactttgtgctgctgttgatggtgttaagtgccggtgggctcggccttcttaaaagtctatgtaactcttctatacttcttattgaggatgatcacttgagctagcatatatttcaaacttatacttttctaatcactccgataaaataatgtaaattttttgtaatctgtaaaatttggtaataagatttccgctgcaaaaatgttggtgtgta

SEQ ID NO: 82791 - DNA, 84 bp, Zea mays
  Clone ID: LIB3114-040-P1-K1-D7
aaaaaaaaaaaaaaaaaaaaaaaaaaaaaaaaaaaaaaaaaaaaaaaaaaaaaaaaaaaaaggaaaaaaaaaaaaaaaaaaaaa

SEQ ID NO: 82792 - DNA, 331 bp, Zea mays
  Clone ID: LIB3114-040-P1-K1-E1
aaaaaaaaaaaaaaaaaaaaaaaaaaaaaaaaaaaaaaaaaaaaaaaattttttttataaaagaggggaaaaaaaaaaagaggaaaaaaaaaaaaaaaaaaaaaaaaaaaaaaaaaaaaaaaaaaaaaaaaaaaaaaaaaaaagggggcgcccttttaaaaaaatcaaattttatttcccctttcttccaactttttattttttttttggggcccctaaattcaatttcattgcccgttttttaaaacctttgaatttgaaaaacccttgggttccccaatttaattccttttgaaaaaaatctcttttttccaatttggggtaaaacaaa

SEQ ID NO: 82793 - DNA, 443 bp, Zea mays
  Clone ID: LIB3114-040-P1-K1-E10
cccacgcgtccgccaacgccctcggagggctcaagtgctacgagaaccccaagcacaaggtcaccgctgtccccgccgacgaagaagagatctgcggtgccactttcaaggtggtggaaggctctactgtcctgacggcgctgcactgatcggtcatcagctggcggaggcgatgcgatgatgatgcagaactttgtacatgcgttggtggatggtggtgtaacatagtggctgccaacaagtcatgctcatgcaaaccgatgaatctatctctgtatcatcgatctcggttgcttgctagtccagactccagacatggctatatatatatagctggtgctaataaataggagtataatcgtcatatcgatcggttgcgtgtggaatgccaatcatgtgtgtaatctgttggcaaataacaaacctctgttccttccaaaaat

SEQ ID NO: 82794 - DNA, 131 bp, Zea mays
  Clone ID: LIB3114-040-P1-K1-E12
taaaaaaaaaaaaaaaaaaaaaaaacaaaaaaaaaaaaaaaaaaaaaaaaaacaaaaagagggaaaaagggtggggggggttagagattccaggtttccgggcccgtggggcgacgtttttcatttttttt

SEQ ID NO: 82795 - DNA, 401 bp, Zea mays
  Clone ID: LIB3114-040-P1-K1-E2
taaaaaaaaaaaaaaaaaaaaaaaaaaaaaaaaaaaaaaaaaaaaaaaaaaaatatttaaagggaaggaaaaaaaaaaaggggcgctttcatacaaccccatctcaacttctatattcccacctaaaattaattaatttagcgggcgttttttttttacttactcttatttcctctccttccctccaccttattcccttttttttacctccctatatttcagctctttcccctttttttaccccctcacctttgtaaaatcctatcatttccccaccttatttttttaaaaaacactccccctttttccaatttttaataaccgcaaaagggccttttccttccccctttcccacattttcttccccccttaataccacccggtccccccccttacttccc

SEQ ID NO: 82796 - DNA, 333 bp, Zea mays
  Clone ID: LIB3114-040-P1-K1-E3
gactagttctatgctctccccaaaaaaaaaaaaaaaaaaaaaaaaaaaaaaaaaataaagggggggaaaaaaaaaaagggggggttataagttaaaaaaacttaaaattaaggggcggcagttttcaaagtgggggccttttttaagggtccctggattccgttttctttccttggggggccaaaaacttatatgggggggcccttttttaaattccgtggctattgttttacaccgtgggggtttgggaatttttttgggggggcccaaattaaaactttttggggctggttttattttggctgggggggggaatcccgggggttccccccc

SEQ ID NO: 82797 - DNA, 250 bp, Zea mays
  Clone ID: LIB3114-040-P1-K1-E9
gacagcgggagctgatcgaggaattcgcgaaggaggagcaaggcgaagacgagaaggacgccaaggcagcagctggagcatcggggggatagccggttttaggagccacagtagtgccttttagctggtatttataccgtgaccgtagacctgtctcaaattcgcagcggaaagatttatagataggtctttgtttcggattttgtagctggaataaatgaataatacgtctagaactgattttctgtct

SEQ ID NO: 82798 - DNA, 340 bp, Zea mays
  Clone ID: LIB3114-040-P1-K1-F1
ttaaaggatccaagcttacatacgcgggggtgcccggtcttaaggttccaaatttacttacccaagtttactacattgtacgttttttatcaagcgacctaaatggaaaaacctggccgttgcttaacaaaatcgggatggagaaaaccctggttttaccaaatttaataatcttgaagaacatcccccttttcgcacttgccaaaatatgcaaaaggtccataccgattggccttcccaatatttgggcaccttaaatgcggaaggggacgcgccttctagcagcgcattaagtacactgggtagggtggtaacgcccagtgttaccgctacatttgct

SEQ ID NO: 82799 - DNA, 416 bp, Zea mays
  Clone ID: LIB3114-040-P1-K1-F10
aaaaaaaaaaaaaaaaaaaaaaaaaaaaaaaaaaaaaaaaaaaaaaaaaaaaaaaaaaagagaaaaaaaaaaaaaaaaaaaaaaaaaaaaaaaaaaaaaaaaaaaaaaaaaaaaaaaaaagggggggcctttttaaagattccaagctttcccccccttgcttgcgccgttttattttttttttagggccccctaatttaaattcattggccgccgtttaacaacgcctggacgggaaaaaccctggctttccccaattaaatccctttgcagcaaatccccttttcccccgctgggttaatagcaaaaaggccccccccgttcgcctttccaaacaatggcccaccctgaatggcaaatgggcccccccctttagcggccctttaaccccgggggggttgggggtttcccccagg

SEQ ID NO: 82800 - DNA, 358 bp, Zea mays
  Clone ID: LIB3114-040-P1-K1-F11
cccacgcgtccgcaggcttcatcctgtacgacaccgagaacctgatcaagcgccacacctacgacgagtacatctgggcgtcggttgggctgtacctcgacatcctgaacctgttcctctccatcctgaacatgctcaggagcatgcaatccgacaactagcctcttgatcgaacacggtatacccccatggtaaatgcggtcctgtgctctggttgttagaggacgggatcgacgtgcgacatatgtattgtgtgagcccactcgtgtcaacactgcaaacaattgtggtcatgtcaccttgtatgttcttggtcacttttcaaacaattgtaagtacctcatatcgttttgcgctt

SEQ ID NO: 82801 - DNA, 223 bp, Zea mays
  Clone ID: LIB3114-040-P1-K1-F12
cgccctagtcctactactaccctctttgtgtgctgccatccatccgtccccgctagacgatcgaggagagaataacgcagagctctgtgctcccggcctctgtcttctgccgtcccggccgtttaatttatagtctctactgtgtgttcgtcccatgtgtttagcagcagcagcaggtgtattgtgcgggtatgtaatggtattgcaactatattgggtgtaa

SEQ ID NO: 82802 - DNA, 236 bp, Zea mays
  Clone ID: LIB3114-040-P1-K1-F6
taaaaaaaaaaaaaaaaaaaacaaaacaataaaaaaaaaaaaaaaaaaacctacccatacaaagggaggccatattaaggacggcgggcgtacctacacttacatgcactgtccggcctcttacatcgagttgactggctaaactttacctgcccccaatttactaggcttgtactggaaccccctttagttagctggccttatatcccttatgccccatccgtttttcttcccca

SEQ ID NO: 82803 - DNA, 401 bp, Zea mays
  Clone ID: LIB3114-040-P1-K1-F7
actagttctataagagaatttggtcaaaaaaaaaaaaaaaaaaaaaaaaaaaaaaagggaaaaaaaaaaaaaaaaaaaaaaaaaaaaaaaaaataaaaaaaaaaaaaaaaaaaaaaaaaaaaaaaaaaaaaaaaaaaaaaaaaaaaaggggggggccgttttaaaggaccaaagtttactaccccgtgcttgcaaagttatagtttttttttaggggccccaaaattaaattcacgggccggggtttaaaaacgtcggaatgggaaaaaccttgggtttcccaaatttaatcgctttgaaaaaaatccccttttcgccagtgggggtaataacaaaaaggcccgccccaatcccctttccaaaaatttgcccaccttaaatggcaaaggggaccccccctt

SEQ ID NO: 82804 - DNA, 275 bp, Zea mays
  Clone ID: LIB3114-040-P1-K1-G1
taaaaaaaaaaaaaaaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaataaaaaaaagggggccgccctttttaaaaattcaaatttttcttccccttgtttgcaaggaaaaattttttttttggggcccccaaattaaaattcacggcccgggttttaaaaccgttttaattggaaaaacctt

SEQ ID NO: 82805 - DNA, 440 bp, Zea mays
  Clone ID: LIB3114-040-P1-K1-G11
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggccccctttttagggacccaatttttttccccccgttcgggcgacgttatattttttttttggggccccaaaattaaatttctcggccctttttttaaaaccgtggagtgggaaaaacccggggtttccccaatttaaatcctttgaaaaaaatcccctttttcccagggtgggaaaataaaaaagggccccccccctttcccttttcaaaaattttccccctctaattgggaaaaggccccccccctttaaccgccctttaacccgcggggggtggggggttcccccccagtgacccctttactt

SEQ ID NO: 82806 - DNA, 76 bp, Zea mays
  Clone ID: LIB3114-040-P1-K1-G12
aaaaaaaaaaaaaaaaaaaaaaaaaaaaaaaaaaaaaaaaaaaaaaaaaaaaaaaaaaaaaaaaaaaaaaaaaaaa

SEQ ID NO: 82807 - DNA, 418 bp, Zea mays
  Clone ID: LIB3114-040-P1-K1-G4
aaaaaaaaaatttatttaaaaaaaaaaaaaaaaaaaaaaaaaaaaaaaaaaaaaaaaaaaaaaaggggaaaagggcggccgggtgtacaggcccacccttacgtacgcgcgcatgcaacgttcttctttttttgtagtgaaacctaatttcatttgccggggcgtttcattttcaacgtctgggcctaggcaaaaccctgaccttttccaaccttaatcggcttgctacccatttcccctttgctcagctggcttattaggggaaacaggccggttcccctttgcccttcctaaccgttgccccattcctgaatgtggactggccttctccctgtacgggaccctcccgcgctgtgggtgttacgctcacccgcaccgtgacctttcccctggcccgcgccctaacgccccttccttt

SEQ ID NO: 82808 - DNA, 81 bp, Zea mays
  Clone ID: LIB3114-040-P1-K1-G5
aaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 82809 - DNA, 76 bp, Zea mays
  Clone ID: LIB3114-040-P1-K1-G6
gtaaatactcccggtttcctcctccacgacccattttcccttccgtttgcaagtgtaaattcggccgtcgcgtatg

SEQ ID NO: 82810 - DNA, 354 bp, Zea mays
  Clone ID: LIB3114-040-P1-K1-G7
ctttttcttcttccaacccatttttccttccttttgctattgagaaggtctttcaacacagggtgaaaacccccttcctatatttctttatatcttcacccccaatataaatttcctttttaacaagatctcattccaatttctcatccattctacatcttatctcttctatacttctacctatatttcattcacttctccgtcctttttacaacatcttttcttgtaaaactcctgtcattaccctaatttaatcagtttttcctataaatccttctttctctcaacttcctttattatctaaaaaaattaaaaaaggtgccccctttcttaaaaattccaaatttactttcc

SEQ ID NO: 82811 - DNA, 436 bp, Zea mays
  Clone ID: LIB3114-040-P1-K1-G9
agaagatgcctataaaagaaaggaagattggccaagctaaggcctgaccagtgttcccggcccactcacaccgaactcgtgaagcacagtttccatcgtatgatgtcgaggaagaggaaaaagaggggcaaagaagaagaaggtgctgtgagcgaagcactggtcgtcgcaccgccatcatcggcggtgtgagtgcatgcagcgaggaagcatgcttgccatgccgtccgcccggagcttcggcgccgcgggctggtggcgtgtgagcagggatgcttcggcggtgcacaagaaagaaggcaagtcttatcggcaagggaaggctaagcctttcttccaggtctccctctctccatctaaatcattctatgtgtttggaggagggggcaatcgatcgttacttactggtctcctgatccttagcggtcatgtctct

SEQ ID NO: 82812 - DNA, 141 bp, Zea mays
  Clone ID: LIB3114-040-P1-K1-H10
ccacgcgtctagttttaaaataggtagcagtcactctaataaaatccaaatttacatacacatacgggaggacgtctttattgtgggagagagtaacctaaatttaatttactggccggtcctttacaatgtgaacaatga

SEQ ID NO: 82813 - DNA, 398 bp, Zea mays
  Clone ID: LIB3114-040-P1-K1-H11
taaaaaaaaaaaaaaaaaaaaaaaaaaaaaaaaaaaaaaaaaaaaaaaaaatttaagagaagggaatttaaaatagggggggggtagaagaaaaaaaattgggtttgcggttttctaaattcaaatttactggcctgggctttcaactgtatcgttttttttaaaccgtgccttaaccaaattaaattgcctggggttaaaacccctttgacttggaaaacctttggtttaaccaacttaacccgcttggctttccatccctttttgccagctggggtgaaaaggaaaagggcccgtccctgtggctttaccaaaaggggggtggcttttatggccaattggaccccccccttttgcgtggctttaaccccgggggcgttggggtttccccctttcct

SEQ ID NO: 82814 - DNA, 157 bp, Zea mays
  Clone ID: LIB3114-040-P1-K1-H12
gcggaagaggcggcattttttgtacaggcgttgagatgatttcatttttcccccttccttttttttctggtagagggaggaggatgtgatggtgaagatgaactgatctggtgttgttgatcgagagtgaggcatatgagatgagatgttatttttt

SEQ ID NO: 82815 - DNA, 105 bp, Zea mays
  Clone ID: LIB3114-040-P1-K1-H3
taataaaaattgataagagagcggccaatataaaaagatccaagcttacaaacaacgtgcaaagcgacgtcatagactctggtgataggggcacctacttcaatt

SEQ ID NO: 82816 - DNA, 450 bp, Zea mays
  Clone ID: LIB3114-040-P1-K1-H4
taaaaaaaaatttatattaagctaactattttaaaaaataaaaaaattaaataacattttaaagggggggtaaaaaaatagggggggggggcactaggggggcccgcttttggggggccgggttctacttcttgggtggggcccccctttcttttctttgggggctcgtaattcattttttctggcccttatttcctaggctctgcccggggaaacccccgcggtgccccctttttttctccctggtccccttttccttttttccgccgcgctttttctcttgcggcccgccccttttgccttttcccaattgtccctcccttttttgcgcttggtgcccccctctttgcggcggtttttcgccgcgtggggtttgtggttcccccccgtgtttcccttcctcttttcgcggctctttggccccttcttttagccttgttcccttttttt

SEQ ID NO: 82817 - DNA, 258 bp, Zea mays
  Clone ID: LIB3114-040-P1-K1-H6
gattgatagggaaacctctgagatgacccgatcttttttcaataacaaaaaaaccataataacccccttgggttaaatctcaaaaggctccacccatctccctttccaacagttttgcacgcccaataggaaatatggacctccctctatatggtcatttaactccgcgcgtgttttgtttactcccaatgtgaccgcttcacttgtcaaagccttaaagccccgatccttttgcttttttttcctttctttttctcc

SEQ ID NO: 82818 - DNA, 175 bp, Zea mays
  Clone ID: LIB3114-040-P1-K1-H7
taataaaaataaaaaaaaaaactaactatttaaaaaaaaacaaacaaacatactcaaaaggggcgtacttatagggggggaatattttcacctaacttcaattcactggtcttctttatacaacgtcctcactaaaaaaactctgtggccaccctattaaatcgttttgccatac

SEQ ID NO: 82819 - DNA, 420 bp, Zea mays
  Clone ID: LIB3114-040-P1-K1-H8
ctgcttccgagggtccactcaagggtatcatgggttatgcggaggaggatctggtttctaccgacttccttggtgacagcaggtcgagcatcttcgacgccaaggccgggatcgctctgaacgaccacttcgtcaagctcgtctcgtggtacgacaacgagtggggctacagcaaccgcgtcgtcgacctgatccgccacatgttcaagacccagtagaggggttttttccccctgcttctcatggatggttgctgcttgtgtatgccgagaataaatgtggatggcgcgtgcctctgggtcgccaggttcatgctgagtctggacatgttttgcacttttgcttcccttcctgctaccatctgtgacagaaccgctcgctaatatgggacctgagattagctttttgctgcttgtggtg

SEQ ID NO: 82820 - DNA, 73 bp, Zea mays
  unsure at all n locations
  Clone ID: LIB3114-042-P1-K1-A10
tctagatgatccaagcttacntactcgtgcgtgcgacgtcataggggttctatantntcacctaaattcaatt

SEQ ID NO: 82821 - DNA, 379 bp, Zea mays
  Clone ID: LIB3114-042-P1-K1-A3
cctttctctacccacgcgtccgaaaaaaaaaaaaataaaaaaaaaaaaaaaaaaaaaaatacaaaaaaaaaaacaataaaacggtaggggtaaaattaaaggaaaaaaaaaaaaaaaaaaaataaaaaagggcccgccgttttaaacgatccaagcttacgaccccttccatcccacctcatacctcttcttttttttcccctaaattcaattcactatccttcttttcacaccttaatcactggaaaaaccctcgcattccccattttaatcacctttcatcacatccccttttccccattttacataataccaaaaaggcctcaaccatacgcccttacaaacatttactcatcctaaatgccaaataacccccccc

SEQ ID NO: 82822 - DNA, 445 bp, Zea mays
  Clone ID: LIB3114-042-P1-K1-A6
aaaaaaataaaaaaaaaaaaaaacaatcaaaaaaaaaaaaaaaaaaaaaacacaaacaaagggaaaaaaaaaaataaaaaaaaaaataacctaaaatacaatacactaaccaaaaaataaacaacaacaaaaacaaaaaaaaccactatttgtccccccctttttaagaccccaatttcatccccctttcctcccctctctttatttttttttttttcccccccaatctcccttcccttcccttttttttccacattttctactggaaaaccccctttttccccccattaaaccccctttaaacccacccccctcccactcattacctttttctaaaaaaacccctccccatttccccttccaaaatatttcccccccttattggctatttcccccccccctttcaccaatctttaacctcccgttttttttttttttcccccct

SEQ ID NO: 82823 - DNA, 430 bp, Zea mays
  unsure at all n locations
  Clone ID: LIB3114-042-P1-K1-A9
cctcctcgacccacgcgttcttactaattctaaaatcacaacctctcaatatatacaaatccacactcacatacccagccattctatatcatagctataaatataacctaaactaaattcacttccctgccctttacaacacaacttctttactaacaatacccttaccctacttaatttactttcattacatcacattttcctcaactcacctaatatcaaatataacattaccgaacccccttcccttcacatcatcatcccaaattgaatatcgaactctcccctcactattacattaacctcaacnccttttatatttacgctccacttaacctttacacttcacttttccctatccctccctccttttcctttctttcttttctctatctccatattcaccttcttttcctttccacctctaaat

SEQ ID NO: 82824 - DNA, 243 bp, Zea mays
  unsure at all n locations
  Clone ID: LIB3114-042-P1-K1-B11
gcgtacatttcctttttgtataaagtatagtatcatctttgtatgttantcctaaggggcgacaaacaaacaggcgagtgaggcctacacctatcatgttccaaaggaaatgcatcactctctctatctaaaaaaaaaaaaaaataaaaaaatcaaaaaaaaaatataataaaaaaaaaaaaaaataaaaaaaaaaaaactaaaaaaataaaaaaaaaaaaaaaaaaaattaaaaaaaaaata

SEQ ID NO: 82825 - DNA, 377 bp, Zea mays
  Clone ID: LIB3114-042-P1-K1-B2
aaataaaaataaataaaaaaaaaaaaaatataaaaaaaaaaaaaaaaaaaaacacaaacatgcgggaaaataactaggggatagactcacctaatttctattctactgcccttctttttacaacttcttttctcttcaaaaccctttctttacctaacttattcgcctttcataacatccccttttctccattctacgtacttccttcaaaaccccctcttttcccccttcccaatatcttctcatcctaaatcccttttctctctctctctgtttctacacattattccccaattcttctttccctacgcgcatttttacctcttcacttgtttaccccctatttccccctccctttaatcacttcccttactttc

SEQ ID NO: 82826 - DNA, 423 bp, Zea mays
  Clone ID: LIB3114-042-P1-K1-B5
aaaaaaaaaaaaaaaaaaaaaaaaaaaaaaaaaaaaaaaaaaaaaaaaaaaaaaaaaaaaggcgggaaaaaaaacaaagggaaaaaaaaaaaaaaaaaataaaaaaataaaaaacggggcgcccttttttaaggatccaattttccttccccttccttgcaacttcatagtttttttttagggccccctaatttcaattcattggccgttttttaacaacctcgttactggaaaaaccctggcttacccaaatttattccctttgaacaacatccccttttccccagttggcttaattaaaaaaaggcccccaccgatcgcctttccaaaaatttgcccacccttaatggcaaatggaaccccccttttaccgcccctttaagcccgggggttttggtttttccccccagttgaacccttaca

SEQ ID NO: 82827 - DNA, 437 bp, Zea mays
  Clone ID: LIB3114-042-P1-K1-B6
aaaaaaaaaaaaaaaaaaaaaaaaaaaaaaaaaaaaaaaaaaaacaaaaaaaaaaaaaacgaacaaaaaaaaaaataaaagagtaaatacaacctatattcaaatcactaccccacttttttacaacctttttatcttataaatcccttcttttttcccaactataataaactgtcctctccctttctatttcctcacctttcctcccttcttttttatccctcacttctttttcttttccccccctttctctattttcttcccctcttttttccccccctatttttgaacaaccccctcttcctcccctttctttcccctttttcatatttcccctctttccagctctttattttcataaatacccctttcctttccttcttcctaaatctcgttccctatttttttctctatagcccccctttctaatttttttt

SEQ ID NO: 82828 - DNA, 74 bp, Zea mays
  Clone ID: LIB3114-042-P1-K1-B9
ttttagaggatccaagctaacgtccgggtgcttgcaacgtaaaagtttttttatagggtcacctaaattaaatt

SEQ ID NO: 82829 - DNA, 184 bp, Zea mays
  Clone ID: LIB3114-042-P1-K1-C11
attcccgggtcgacccactcatccggactagttctagattgctccatcacattcccctaaaaaaaaaaaaaaaaaaaaagagagaaaaaaaaaaaaagggagaaaaaaaaaaaaactcaaaaaaactaactcatccatactactcccttaatttactatactaacacttttttttacatctaac

SEQ ID NO: 82830 - DNA, 116 bp, Zea mays
  Clone ID: LIB3114-042-P1-K1-C3
ataaactaaaactaaattatactaaaaaatcacctaaaaaaaaagaaacatataaaaaaaggatgggacatactatcggggcgatgtattaagtgcaactgttattacaagatttc

SEQ ID NO: 82831 - DNA, 313 bp, Zea mays
  Clone ID: LIB3114-042-P1-K1-C4
taaaaaaaaaaataaaaaaaaaaaaaaaaaaaaaaaaaaaaaaaaaaaacaaaaaaaaaatagaaagaacataaataaaagtgcactattcttatcttctatttttttctccccaatttcatttcactttaaataaattctcccttatctatattatccaagctctctttctttttcttcctattctcctacctttctctatcctttcaccttcactctctttactatccctcttctttccccctttttactttttaatccctttccccaccctactttattatctttactcccatccacctttcccctaaaa

SEQ ID NO: 82832 - DNA, 372 bp, Zea mays
  unsure at all n locations
  Clone ID: LIB3114-042-P1-K1-C6
gactagttctaaaaaaaaaaaaaaaaaaaaaaaaaaaaaaaaaaaaaaaaaaaaaaaaaagaaggggacaaacaaatgaggtgggtccatttctttccccctttttcctccatcntcttcacctcttttttaattcctcatattttcttttccctccccctttttccacttctttttttccttaaaacccccctttctacccccctttttaccctctcctttactacatccctttttccccatttttcttatttattattattcccccacctatccctcttacccatatttcctccccctttttccccttttccccccttcctttcttatctctttttcttcccctattttttctacttttcttcccccttt

SEQ ID NO: 82833 - DNA, 151 bp, Zea mays
  Clone ID: LIB3114-042-P1-K1-D10
ctaagaagggcaaccaggggagtgaactaaactcttttaactaaaaaaaaaaaaaaaaaaaaaaaaaaaaaaaaaaaaaaaaaaaaaaaaaataaaacaccaaataaaaaaaaaaaaaaatacattcttatttagacctaattacttaata

SEQ ID NO: 82834 - DNA, 473 bp, Zea mays
  Clone ID: LIB3114-042-P1-K1-D12
ctacgcctgcagtaccggtccttaattccctggtcgacccactcgtccgaaaaaaaaaaaaaaaaaaaaaaaaaaaaaaaaaaaaaaaaaaaaaaaaaaaaaaaaagagggaaaaaatacattcgggtaaattccaaccttaaatacctcttttctttcctactcctaaattcttttttcttttccctctatttccaattcatttcactttctatttccttatttttttcctattttgccccctcttttattccatccccttttccctcccctttctttctacctttatatccctttttttttttccccttattccattttcctcccccttttttcacccctttacccaccccctaaaccccctctttccccccacttttttctcttctttttttccccccccctttccccttttcttttcttattttatatttcccttcctttcccttttttcccattttcctccccttttt

SEQ ID NO: 82835 - DNA, 304 bp, Zea mays
  Clone ID: LIB3114-042-P1-K1-D2
aaaaaaaaaaaaaaaaaaaaaaaaaaaaaaaaaaaaaaacaaaaaaactaataaaaaaagtggctggaaaaaaacaaatggggaacccttactcacttcttatttaatccttctctttattcttctactcttcctttaacttactattttttttctggcaccctctcctatataatccttttttacctccccttcaattccacttcttacctcctctattttttcccctattttcatttcactcctcccctcttccttcttccttcctattaatcacccttatctttccccctcttacccctct

SEQ ID NO: 82836 - DNA, 170 bp, Zea mays
  unsure at all n locations
  Clone ID: LIB3114-042-P1-K1-D5
cgttccggaattcccggggcggcgcacgcgtccgaaataaaaataaaaaaaaaaaaaaacactaataaaaaaaaacaaacatacatacaaaaacgatgagcaacataacggggggggagtctcaccttccttcatttcacttcccnttccttcacaacctctgcactact

SEQ ID NO: 82837 - DNA, 243 bp, Zea mays
  Clone ID: LIB3114-042-P1-K1-D6
aacaccccgtctgtaacattcgccagagtatatacgaaatccatgttaatataccctccaaagaaaaaaaacaaaaaaggaaaaaaaaacaaaaaaaaataaacaataccaaaaatacacatcaaaaaaaactaaaacaaaaccctattattacccatctcaatactctttcaacacatcctacttatcccagccttcatcatacctaatacttcctcacccatcccccttcccaacattttc

SEQ ID NO: 82838 - DNA, 52 bp, Zea mays
  unsure at all n locations
  Clone ID: LIB3114-042-P1-K1-D9
gactcgcccttgaccggcccattaatcccngctttttttcgcgggtaggggg

SEQ ID NO: 82839 - DNA, 372 bp, Zea mays
  Clone ID: LIB3114-042-P1-K1-E10
taaaaaaaaaaaaaaaaaaaaaaaaaaaaaaaaaaaaaaaaaaaaaaaaaaaacaaaaaagaaaaaaaaaaaaaaagggggaaaaaaatatactctcttcttctttctcctctccccaattatcctcctatttttcttactccccctcaccctttctaatcccccacctccatctattatacaaaaacttctcatttctaacacctttccatttaactaaccatcatcccatcaacaaacccccctcttcttttttttcacattcttcattcaaccctcctctaccttcctctcaatctccaacactcttttttttgccactacccctttcccctacttcttttttttttcctgtcccaaccctcacatctt

SEQ ID NO: 82840 - DNA, 331 bp, Zea mays
  unsure at all n locations
  Clone ID: LIB3114-042-P1-K1-E5
ccggaattcccggggggagcaggcgtgcgtgttttttttttttttacggcgccaaacccaacatttacatccattatttctggttccgggggcctnaacattgggatactggataccacaccttggtcacatacgcggaactggaccaacgcatccaagcgccctgcacagacacaaacaagcacgcgacatatagacgaatctaccatggggaaacctcccagtctccgacccacgacgcatcaacagacccccggcttcttcttggtcacggggttcatccaggggacggggacctcccggtcgatctacancacgcttttcttgggca

SEQ ID NO: 82841 - DNA, 355 bp, Zea mays
  Clone ID: LIB3114-042-P1-K1-E6
aaataatataaaataaaaaaaaaaccaattaaaaaatatccaaacttactatacaaacctggcgagcgaaaaattagggggtggttaaacctaattttattccattccccaattttttccaccttcttacttggaaaaccctttaattacccaaccccccttcttttactaaaaatccccctttcccaaccttcctatttttcacttttttcttacccacctaaatttcctaacatttccccttttttatctattatttcacactaaacctctatgtgtccccccaactaatctccttttttaaactcccccctttttcccctttccttttttaaaaaccttcccccccaatcct

SEQ ID NO: 82842 - DNA, 305 bp, Zea mays
  Clone ID: LIB3114-042-P1-K1-F10
aaaaaaaataaaaaaaaaaaataaaaaaaaaaaaaaaaaaaataataaaaaaaaaaaaaaagaaaacacaaaaaaaagtgtacacccaaccaaattcatactttctattcctatctttcactactacatattttattaacattctacatcctactcaaactacaaatatttctatatgcctttccttattttatactatcctcattactactctttatcccatttactttttttcttttttctcctattacatattattattttccctatttatactctttttttacttcaaaccctctatcccc

SEQ ID NO: 82843 - DNA, 443 bp, Zea mays
  Clone ID: LIB3114-042-P1-K1-F2
ttctttttctcctccagtaccggtccctaattcccttgtcgacccactcgtcctaaataaaaaaaaaaataaaaaaattataaaaaatttaaattaaaataaaataaaaaaattggcggggaaaaaattaaaagagttgactttatctataatttttttttcttcttccttctttccctcttttttctctttcctttttttttctttccttctttttttttctttttttcttttcttttcctctttctctctttcttctcttttcccctttttctcctatttttttttttcctttcccctttttttttttttttttcctttctccccctttttccccccttttctttttttttctttttcttttttttcctcttttttttttcctttccttctccctttttttttttttcccatctcttttttcccctttttctttttttttt

SEQ ID NO: 82844 - DNA, 203 bp, Zea mays
  Clone ID: LIB3114-042-P1-K1-F5
ttttatacatccaatcttaatactctttcatgcggcgtctatctattctatactatcacctaaatttaatttactctccttctttttacaacatcttcactatcaaaaccctttcattacccaacttaatccccttacaacacatcccactttctccatcttcctttatatcaaattatccccctcctatcacccttcccaac

SEQ ID NO: 82845 - DNA, 410 bp, Zea mays
  Clone ID: LIB3114-042-P1-K1-F7
aaaaaaaaaaaaaaaaaaaaaaaaaaaaaaaaaaaaaaaaaaaaaaaacacaacctaggtgaagaaaaacaaactaacatacacatacatacatacatcatatctcttttttcgtttcacctaaattctcttcacttcccccccttttccatcacccgtaactgttttttttccttccctttcccattttattccccttccatcacatccccctttctccatctaccttactttctaaaaaccccattctcttcgtccttaccaacatttcttctttcctgattttgaaaataaaacacacccctccagcccgctctttcatctcttgatggtttccttgcttcccaccaaaaccccccttccctttcctcctcccatacccccccttcctttttttttctatccttcct

SEQ ID NO: 82846 - DNA, 445 bp, Zea mays
  Clone ID: LIB3114-042-P1-K1-F9
cgcctgcaggtgccgggccggaattcccggggggggccacgcgtgcgcagccatctagtgggtgggctccgggggggggacaggggatgcgtgcggatcggggggggtggacgcggcggtggggggcgcccagccaaacacgacttactggtcggatcgggacgactacatggtctgggacatggtacatcctacgcaggcaacaaatggacggggggggggcggcatcttctacgggccggaggggtgcgcggatcccatcaactttggacaggtgggcggtggcacaggaaatggtgatgatgatataaatactggtatggccggagggggctatgccggcatatgataaacactatttatggctattggcatgcagctgggacatggcactacctgaggactatatacgtaattcagggggaataatgtgcgtggggtgctt

SEQ ID NO: 82847 - DNA, 102 bp, Zea mays
  Clone ID: LIB3114-042-P1-K1-G11
aactaaatctaaaatcacaagcagccaatctaaaaaaatccaagcttacatacacgggcgggcgacctcatagctctggtataacctcacctaaattcaatt

SEQ ID NO: 82848 - DNA, 316 bp, Zea mays
  Clone ID: LIB3114-042-P1-K1-G5
aaataataataataaaaaaaacaaccattttaaaaaaaacaaaactaacttccccttcctggcagagtccaaatacttactgggcggcgtgtctaactataatttacattctattttcccgtatcttaccaacttatttctttggaaaacctttcctttccccactttattcaccttcctgaaattcccctttttaccagtttcctaattaataaaaattcccccccctttcgcccttccaaacatttccccacctttatttcctattagaacccccctcttttttactttttatcccccccgcttttttttttcc

SEQ ID NO: 82849 - DNA, 224 bp, Zea mays
  Clone ID: LIB3114-042-P1-K1-G8
tctaatttcaatcacatttgcccctttatatcaccatcgcgtaataccgaaaaagcccttacctatcccccttaaaaacacttgcacaacctgcatgtttaatgggacgccctttttcccttcacatcaatccctattggtgttgcggacactggcagcgcctcttttacacttggcaccccccttgtgcccggtcctttcgctctctttgtttgcttttttcc

SEQ ID NO: 82850 - DNA, 306 bp, Zea mays
  Clone ID: LIB3114-049-P1-K1-A11
gatggagttcaccgaggccgagagcaacatgaacgacctcgtgtcggagtaccagcagtaccaggacgcgactgccgacgaggaggagtacgaggacgaggaggaggtgcaggccgatgacatgtgaggggagggctgttatcgtgtgaagccttgtggtccctagggcaagcggacctcgatgagttcggtgttccctttcgtgttgttgccatctttctactgctagcgtacccaccctcgtggcccattccgtcgctgttgacgtatgtatttttcttgtgctatggaaccttgcttttggta

SEQ ID NO: 82851 - DNA, 421 bp, Zea mays
  Clone ID: LIB3114-049-P1-K1-A2
gggtgcgatgcccagagcttatttatatttttatctaaaaaaataaaaaaaaaaaaaaaaaaaagggcggggcgtttttaaaagaggggggggccttctaaatattaaatacaaactaaaaaagccatgaaccctttgtttatgcctatatatgtttgttttttaatttgtggaatttttttagatttttaacgagtttcaaaggggggggttttttggggggtcctttttttcccccctttttgttgcagttctttttatttttttttttggcctccttttttaccattgggcgtttctttaaattactgtttttttggggagagcccggcgttccccccttttaaatccgtgtgacaactttttcttttttggggggtggtttttataaaggggggttcgctctctcgcgttttttaaa

SEQ ID NO: 82852 - DNA, 311 bp, Zea mays
  Clone ID: LIB3114-049-P1-K1-A3
aaaaaaaaaaataaaaaaaaataaaaaaaaatttaaaaaaaaaaacaaaaaatataaaaggaaaaattttaaatactaaaaacgtccccaattataactcttttttttggccccctcttttttatgtcctgtccttttttcttcaccttccgcccttggaattcccttttgtttccctaaaattactttttctgccccatttttttttcccccctttttgtaaaccctttgaggttcccaccttttacccttttcaacaaaatcccatttttcctcactaatttctttctccatattcccccccttttccc

SEQ ID NO: 82853 - DNA, 430 bp, Zea mays
  unsure at all n locations
  Clone ID: LIB3114-049-P1-K1-A4
tgttgtaaaccaaatccatggcgtgcctgttgactgggcattgggtgctttcattgtgcagacgacgatgaacagaacagacattgtccattctaaggtggagaaaacctcgtctgaagacgatctacgatatggagaaaggcaggtacatcataacaagggtcagccaatgagtcgcgcacatcagcgttgggagtgggtggactttctgcagcggagcactattgaccatgtatgtagattttcctaaattgatttcttacttagtggccaactacctccagcatgttgccttgcggagtcaacttgttgagtttgagcagcaacccctgtatatgatagaaagatgcgggttgccgtggcatttgggcatggtcaggggttgatgtaatgtngctaaactgtngttgatgtaattagaattttgtgc

SEQ ID NO: 82854 - DNA, 105 bp, Zea mays
  Clone ID: LIB3114-049-P1-K1-A6
aaataaaaataaataaaaaagcagacaatataaaagaatacaagcttacgtacacaaaacgggcagcgaaataaaaaaggggggggggtcacactaaatacaatt

SEQ ID NO: 82855 - DNA, 305 bp, Zea mays
  Clone ID: LIB3114-049-P1-K1-A7
accggttcggaattcccggcggcgacgccacgcgtccggtgaggccctggtagtcggcggcgcccgcgtcctcgccgtcgaggagctgctgcggcgtcgattcagcgagcctctagacccccctgtatgttccatccagactagagtgccatgatccttctgttcatgctgtgtgtgtgtgtgtttaatctgtggagtctgtaggataataacggggtgcaatgcaaacgtgcccgactcctgtactttgaaaccgtattttgctcttgttcatctaggacaataattgccttcggttttcccaa

SEQ ID NO: 82856 - DNA, 327 bp, Zea mays
  Clone ID: LIB3114-049-P1-K1-A8
cagactccttggaaaaaaaaaaaactttcataacaaaacaaaaaaaaaatacccgacccgtttataaaaaaaccacaatacaccccaataattaaaaccatacaaactaaaaacccataaatccttataaatcatcctccccccttttaaatatcccaatctaaattcccctccattacacacacatatcttttttatagtgcccccaaaattaaattcactcccctcttttttacaacttttaacttgaaaaaaccttgccttaccccaatttaattcctttacacaaaatccccttttccccagttgctttataccaaaaacccc

SEQ ID NO: 82857 - DNA, 235 bp, Zea mays
  Clone ID: LIB3114-049-P1-K1-B10
cccacgcgtccgatttgtattgtatgaatcaaaaaaaaaaaaaaaaaaaaaaaaaaaggggaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggatccaagtttacttccccgtgcttgcaaggtaatagtttttttttaggggcccctaaattaaattcctg

SEQ ID NO: 82858 - DNA, 474 bp, Zea mays
  Clone ID: LIB3114-049-P1-K1-B12
tcgaaaataaaaaaataaataaaataataaaaataataaaaatataaagaaagacacaaacaaatataataatatataaataagcaagcagaatatatataataataaataagagagaaaagaaactataaattaataataattaaataataaatataaaatttttatttataaaaatattataataaaaatggggggggcctttttaaaaatttcatttttttcttcccttttttttcaaattttttttttttttttttgtccccataatttattttccggggccgctttttttaacctttgtttttggaaaacctttgttttcccctattttattgttttttgaaaaaatttcctttttttcccgtgttgtgtttaattataaaaggccccccccttatttttttttttttaaatattttctctctttttttttattttattttggccccccccccttttattttccatttt

SEQ ID NO: 82859 - DNA, 430 bp, Zea mays
  Clone ID: LIB3114-049-P1-K1-B3
gttcctcatccgcctcccgcccgacgaccccgcgagcctcgtcaacgcctccctcgtctgcaagcggtggagccgcctcatcgccggccgcgtcttccgccgcaagttccgcaagatccaccgcgccaagctgctgcacatggcccgggggcaggtctataggcagcggcggcgacggcggcagcggcagtgatggagcggcccgtccggtccgaccgtcgattggctgcttgctctgcatcttctggcttctgcaaccaggaagctgactgaacgctcgctattgccaataattaattagtactattttcttcgtttcttttttttatttgtcgtatacgaactaaaacagagttagtgataatgataatgataatttgtagcagtgcaaagtgccaaaccccgttgcttgcgtaccttgtggatgtat

SEQ ID NO: 82860 - DNA, 160 bp, Zea mays
  Clone ID: LIB3114-049-P1-K1-B8
aaaaaaaaaaaaaaaaaaaaaaaaaaaaaaaaaaaaaaaaaaaaaaaaaaaaaagggggggggaaaaaaaaaaaagggggcggccgttttaaaggatccaagtttacttccccgtgcttgcaacgtaatagcttttttatagggccacctaaatccaatt

SEQ ID NO: 82861 - DNA, 315 bp, Zea mays
  Clone ID: LIB3114-049-P1-K1-C12
aaaaaaaaaaaaaaaaaaaaaaaaaaaaaaaaaaaaaaaaaaaaaaaaaaaaaaaaaaaggggaaaaaaaaaaaaaaaaaaaaaaaaaaaaaaaaaaaaaaaaaaaaaaaaaaaaaaagggggcggcccttttaagggacccaattttccttccccgtgtttgcaactttttattttttttttggggcccctaaatttaatttcccggcccggttttttccaccttggggcttggaaaaccctgggcttccccaaatttaatcccttgggagcaattccttttttccccacttgggttaatagcaagagggcccc

SEQ ID NO: 82862 - DNA, 362 bp, Zea mays
  Clone ID: LIB3114-049-P1-K1-C3
cctcgatgggacttgcgagagtttgatgttcatcgaggcatcttgtcgaaaaaaaaggggggggggaaaaaaaaaggggggagagacaaaataaggggaaccaaatttacgaacaccagcatgccacccgcctggctcttctatcgtggcccctttttttcgtcccctttccttttttttccggctccgtttctggaccccccttgctgtgccccccctgcgttgccccccttttatttccggtttccccattcccctttcgcccgcgggggtttccacctattgcccttcccaacattctccttttccccacttggcgtctccctccttgcccctgtggcccccccccctattctgccctc

SEQ ID NO: 82863 - DNA, 251 bp, Zea mays
  Clone ID: LIB3114-049-P1-K1-C4
tccgcacagcataggggcgctacgatcagacagaaatacatatgtgagaagggttttgatcttcttgggatgcttggaacaaattcacttccgaggagcgctagggtggcgggggtgctagagcggccgtttattttgaggcaggcgattcgtatattttctatagcgacgtcgtcagtttcttgattcaaaactgattgtaaatatgcagttggcgccctagatatccgtgttagaaacacagggcagat

SEQ ID NO: 82864 - DNA, 82 bp, Zea mays
  Clone ID: LIB3114-049-P1-K1-C6
attgtaatctagcatgacctcagatttaaatctgtgtagtggagcatgctatataataacgggtgaaaaaaaaaaggaaagg

SEQ ID NO: 82865 - DNA, 68 bp, Zea mays
  Clone ID: LIB3114-049-P1-K1-C7
cgttatggttggattgtacgcaccatttaattatgaacagctgctacctatatatataatatttgcct

SEQ ID NO: 82866 - DNA, 193 bp, Zea mays
  Clone ID: LIB3114-049-P1-K1-C8
aaaaaaaaaaaaaaaaaaaaaaaaaaaaaaaaaaaaaaaaaaaaaaaaaaaaaaggggaggggaaaaaataaaaagaggaaaaagattataaaaaatttaaaaattgggggggccgttttaagggttccaattttccttcctcttgtttgcgacctcttatctttttttttgtggcccttaaattaaattcat

SEQ ID NO: 82867 - DNA, 173 bp, Zea mays
  Clone ID: LIB3114-049-P1-K1-D10
cccacgcgtccgaaaaaaaaaaaaaaaaaaataaaaaaaaaaaaaaaaaataaaaggaaggggaaaaaaaaaaagcgagaataaaagaattgctctatcatatttctcgtgtcttctcgtctacttacctccttcttgttgtgttcctttattttttttttgggggtcattat

SEQ ID NO: 82868 - DNA, 379 bp, Zea mays
  Clone ID: LIB3114-049-P1-K1-D12
ctttcagatggcttatagccaagtgttggttaaattgagtccatgaaccatcaattatatccatgacgtgtagacggtatgggaatttagcatctgaattttctcgaaaaaaaaaaaaaaaaaaaaaaaaaaaaaaaaaaaaaaaaaaaaaaaaaaaaaaaaaaaaaaaaaaaaaaaagggcagccaaaataaaggaaaccaacataaaaaacccatacatgcaaaaaaattaactttcttataaaaacacttaaattaaattaattggccggggttttacaactaatggtttggaaaaactttggcgttgcccaattaaatcgtcttgcagaaaatcccctaactatccagtagtccgaaatagcaaaaaggccttga

SEQ ID NO: 82869 - DNA, 268 bp, Zea mays
  Clone ID: LIB3114-049-P1-K1-D6
actcaccatttaattatgaacagccgctacctatatatataatattcgccttcttttttggggctaaaaaaaaagaggaggaaaaaacaaaaaaaaaaaaaaaaaaaaaaaaaaaaaacaaaaaaaaaaaaaaaaaaaataaataaaatcatcaaacacttattaacaaggggggggcccttttaaaggaccaaagttaccttacgcggcgaggcaaggtcatagtttttttatggggtcccccaaatctaattcacgggccggggtt

SEQ ID NO: 82870 - DNA, 225 bp, Zea mays
  unsure at all n locations
  Clone ID: LIB3114-049-P1-K1-D7
tttctcctgcagtaccnttccnnattcccggggcgacccacgcgttctaaaaaaaaaaaaaaaaaaaaaaaaatatatataaaaataaaaaataaaaaaaagggggggagtaataaaaaaaggtggtctattaccaaaattcatttttacttttctctttttacttccatattatttttctataaattacctaattttaattaacttttcttacaataataactt

SEQ ID NO: 82871 - DNA, 81 bp, Zea mays
  Clone ID: LIB3114-049-P1-K1-D8
cgctactcgagaggattgttgctctgggacttcctatgtcacatcacttgtagcgagacggtgtgattcctaaggtgaacc

SEQ ID NO: 82872 - DNA, 144 bp, Zea mays
  Clone ID: LIB3114-049-P1-K1-D9
acgcctggcggttctggtttggtaattcccggggggggcccacgcgttcgtaataaaaaatatgataataagaaaaattgtttttatttaaggtttaatttggggggggggttttggggggggggggtgtattttttttttggt

SEQ ID NO: 82873 - DNA, 376 bp, Zea mays
  Clone ID: LIB3114-049-P1-K1-E12
aattattataaaaaaatgaaaaacaaaagataatattaaaataatgaaaaaaaaaacagtggggggactgtcaaaacggggggggccgcctttttagcggttccatgcttcctcccccgttcttcccacttgctcccttttttttcgggtcccgctcggtttaatccctggcccgtcttttttcaactgccttgcgggaaaaccctttggctcccccagcttaattcccttggaggccatccccttttccccttctggtgtattgatcaaagggcccgcccaattggcttttcccaatagttgccctttcggcttggtttttgggactccctctctcccggtcctttatccgctggggggggggctgttcccccca

SEQ ID NO: 82874 - DNA, 270 bp, Zea mays
  Clone ID: LIB3114-049-P1-K1-E2
ctgatttcttgttgaaataaaaaaaaaaaaaaaaaaaaacaaaaaaaaaaaaaaaaaaagtggggggacatatctagtggatgcgggcttataaactcaagtctctgacgcgatctgtataccatagtggactgtgaatacactggactggcccacgttaatcaacttgcagtatattaaaattttggcaggtgccaacttaacggccaggcaggaaatgctcgtttttccagacagtggaatagcctgaatggcgactgcgatccgcct

SEQ ID NO: 82875 - DNA, 164 bp, Zea mays
  Clone ID: LIB3114-049-P1-K1-E5
ggtccggaaggtggagaagttcatcacgcacagcgtcccgttcgtccagatcaacaatactttctaccggagggccaaggagggggggaggcgctgcataatccgcatggagaactagatttcgctgtctagtttgtgatctggcctgggcttgggggtaataa

SEQ ID NO: 82876 - DNA, 205 bp, Zea mays
  Clone ID: LIB3114-049-P1-K1-E6
gcgtccgaaaaaaaaaaaaaaaaaaaaaaaaaaaaaaaaaaaaaaaaaaaaaaaacaaaaaaaaaaaaaacggggggaaaaaaaaaaagggggagaaaaaaaaaaaaaaaaaaaaaaagggggcggcccttttaaaggatccaagtttacttccccgtgtttccaacgtaataccttttttatgggggccccaaattaaaattcc

SEQ ID NO: 82877 - DNA, 180 bp, Zea mays
  Clone ID: LIB3114-049-P1-K1-E9
aaataaaaaaaaaaaaaaaaaaaaaaaattttttaaaaattaaaattcttactgtgtggcgttccagcttcgtcttcttctcttcttttctttcttttgttcttacttcttttctccctcgtttctctcctttctgtttctttcttcccttattttttgctctcttttccttcctttttt

SEQ ID NO: 82878 - DNA, 183 bp, Zea mays
  Clone ID: LIB3114-049-P1-K1-F10
aatccaaccttctttccccgcccttgcatcctatttttttttttttttgggcccctaaataaattcctttgcccgcctttttccaaccaacgtgattggaaaacccctccgctgtccccaccttattaattttcctaaaaatcctcttttcttcccctgggtgaataataaaaaggccccccc

SEQ ID NO: 82879 - DNA, 255 bp, Zea mays
  Clone ID: LIB3114-049-P1-K1-F7
aatgactgcagttcttagagagacatcatgattgggatgaattcaatactttgccagacatcaataaatactccatttgtcccaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccgttttaaaggatccaagtttacttacccgtgcatgcaacgtaataacttttttataggggcacctaaattaaatta

SEQ ID NO: 82880 - DNA, 111 bp, Zea mays
  Clone ID: LIB3114-049-P1-K1-F8
attcccggggggacccacgcgtccgaaaaaaaaaaaaaataaaaaaaaaaaaaatatattaaaaaaaaaaaaaataattagggggggggtaaataaatagggggggttgct

SEQ ID NO: 82881 - DNA, 294 bp, Zea mays
  Clone ID: LIB3114-049-P1-K1-G10
gtcaaaaaacgaagagaaaaaattaaaaaaagggaaagaaacaaaacatacttacaatcaaatacttctctaattaaattcctcgtctccttctactaccttctcttttcctcatcttccttttatttttattacatttttttcactttacttttttttatttttgtacccccctttttaccccccctatactcttcttatcctaactttttcttttttttactccctcctcttctaatcacttttatcctttcccttttttcttttctatcttccttttttatcctccttttt

SEQ ID NO: 82882 - DNA, 265 bp, Zea mays
  Clone ID: LIB3114-049-P1-K1-G12
agttgatttgggtcatatttgtaggaaaattgccttcaaattcagtatactgcgttgatgttctagtttaataaaggattgtatgttctgttcattctcaagcttaaataaaggtttgccatatcagagttgagcgttttaattgagcttaatatttaatttgagacttgaaatttgattgtaatccactattatgtgaatcaaaagcctttcttttttgttcttacaacagatgcacaaactgaatggcaaatgggacgcgccc

SEQ ID NO: 82883 - DNA, 381 bp, Zea mays
  Clone ID: LIB3114-049-P1-K1-G6
aatatttgtaatattattgtgtatatatgtggagacaaatccttgttcgattagtctcggcagcggtctaatatatggaggggactaaaaaaaaaaaaaaaaaaaaaaaaaaaaaacaaaaaaaaaaaaaaaaaaaacaaaaaaaaaacaacaaaaaaaacaaaaaaaaaacaaaaacacaaaaaaaaaaaaaaacaaaaaaagcgggcggcccctcaaaaaaaccaacattaccacccccgcccacccaaaacaaaacctcttcaaacgcccccccaaaatcaaatcacccccccccggttaaacaaccgccgccagggaaaacccctgccatacccaacaaaaaccccctccaaaaacaccccctttcccccaccggcc

SEQ ID NO: 82884 - DNA, 416 bp, Zea mays
  Clone ID: LIB3114-049-P1-K1-G7
agcacaagcacaagaaggtgaagctcgcagtgctgcagttctacaaggtggacgacgccaccggcaaggtgacccgcctccgcaaggagtgccccaacaccgagtgcggtgcgggtgtcttcatggccaaccacttcgaccgccactactgcggcaagtgcggcctcacctacgtctacaatcagaaggcgtaatcccatgcgccgctttgcttcacccgcctacctatcaagcattcacctgttggttactcgatttgaatatcatttagatctggttgaggttggaacataaatgcagcagtagtttttgtctaaaaaaaaaaaaaaaaaggggggccgttctagaagattccaagtttaccttacgcctgccttgcgacgttataagttctttttttaggggccccttaaatt

SEQ ID NO: 82885 - DNA, 242 bp, Zea mays
  Clone ID: LIB3114-049-P1-K1-H10
gctagatccgcgctggacgcgtggtttctgcttgatttgtgattcgtctggcgcgagtggagtccgtgtcgtgcgcgtgtctgtgtgagttgtttcggcgggcgtgtgtctgtatgtatggagtcggtggcggaggaggaggtgtgcgcgtggtggtacgtgcgtcgacgctccattgtttgtggcggcgatcatgtgcctgccccgttttctggttatcaatgagatgatttatttgattc

SEQ ID NO: 82886 - DNA, 104 bp, Zea mays
  Clone ID: LIB3114-049-P1-K1-H5
cgtccggagctgcctgccaatgttgctgaccttctgtgatcaatttcaagaaaaaacaaaacacaaaaccgctggtgaggaacctggcgaggcttggttttgtc

SEQ ID NO: 82887 - DNA, 144 bp, Zea mays
  Clone ID: LIB3114-049-P1-K1-H6
gccggtcccggtccggaattcccgggggggcgccacgcgtccggaataaaaaaaaaaaaaaaggcggccgttctaaaaaaaacaagattacataacagaagggggggaaaaaagggggggggatagtgtcacctaaattcaatt

SEQ ID NO: 82888 - DNA, 321 bp, Zea mays
  Clone ID: LIB3114-049-P1-K1-H7
aatggaaagtccagtgtagtttggggttgtgtttgtttgagtgtttagggtaggcctattatgtggggttggctggggtacaatatgagatctgcaagaaacaagagaagttgaatcatctaggagttgttttgtaaggggagatctttaaattctagggggatagttgtatgatggggccagccatgatgcattgttttgtgcatttctcatacaataaaaaaaaagttctcatcctgaatgttatattgccaccttttcttttgtttgtgcattcattcatcttcttcggtggtggtggttcgtctccacatggcctct

SEQ ID NO: 82889 - DNA, 400 bp, Zea mays
  Clone ID: LIB3114-049-P1-K1-H9
aaaaaaaaaaaaaaaaaaaaaaaaaaaaaaaaaaaaaaaaaaaaaaaaaaaaaaaagaggggggttaaaaaaaaagggaggcgaaaaaaaaaaaaaaaaaaaaaaaataacttaatataatataaaattaacattattttataaaacataagggggggggcttttttgggggttccctgtttttttccccttttttgcaattttttttttttttttttgggccccttaatttaatttccgggccggggtttttccaccctgggttggggaaaacccttgggtttccccatttttttggtttggggccatttcccttttttccggggggggtttttggggaggggcccccccccgtccccctttttcaaagggggccccccctttgagggggtttggggcc

SEQ ID NO: 82890 - DNA, 274 bp, Zea mays
  unsure at all n locations
  Clone ID: LIB3114-050-P1-K1-A5
gcactgcactgtacactactgtaaagcggcagcggtgctatacaccatcagcactaatagtatttgtgtctagtccatgctgcagccacctcatccatgagtaggccacttaaactttttttccttcaactgctgactggggatgggggtgcgcgcattcgggtagccgtcaaaatcatccgccgcactggacgcctgcaccgtgactaggagatgattcatcaaacgtancangagcgcgcgcgttcggtaggctgtccgagatcaaaagctt

SEQ ID NO: 82891 - DNA, 226 bp, Zea mays
  unsure at all n locations
  Clone ID: LIB3114-050-P1-K1-A6
gcactgcactttacactactgtaaaacggcagcgggggtgggcaccatcancactaatagtatttgtgtctagtccatgctgcacccacctaatccatgagtaggccaggtaaactttttttccttcaactgctgactggggatgggggtgcgcgcattcgggtagccgccaaaatcatccgccgcactgcacgcctgcaccgtgactaggagatgattcatcaaa

SEQ ID NO: 82892 - DNA, 88 bp, Zea mays
  Clone ID: LIB3114-050-P1-K1-B1
aaaaaaaaaaaaaaaaaaaaaaaaaaaaaaaaaaaaaaaaaggggggggggggaaaagggaggggggggggggggaaaaaaatccttc

SEQ ID NO: 82893 - DNA, 444 bp, Zea mays
  Clone ID: LIB3114-050-P1-K1-B11
ctggtcgcctgcagtaccggtccgaattcccgggggggcgcgcgtccgggttctgcgggggctgcggctgatgatcacgatctatacacctagtttggttggtcagtgtgattcccgtgactgcgtgtggttaaaactgatcatactaaacacgctgggcatgcaatggtatttatttggcggacatttggacgtgggggggatggtgcgcaacaaaaaaaaaagaacataaggggaaaaaatgaatggaggaaaaaaagaaggaaaaaaaaataggaagggcaaagacaaaaaatagggggggcgaaactttaggggggccaagttaaaaaaactataacatcaggggggggcgttttaggggggccaaacttacttccggtgggatgcgacggtattttttttttttggggggggcaaaatcaattgggcggggggggtttt

SEQ ID NO: 82894 - DNA, 465 bp, Zea mays
  unsure at all n locations
  Clone ID: LIB3114-050-P1-K1-B2
gtacgcctgcagtaccgntccngaattcccgggtggggcgacgcgtccgcccacgcgtccgaaaaaaaaaaaaaaaaaaaaaaaaaaaaaaaaaaaaaaaaaaaaaaaggggggggggaaaaaaagggggggggaaaaaaaaaaaaacaaaaaaaaaaaacacgtacatacggggggggccgttttaaaatacccaaacttacttccacttgcatgccacgtcatattttttttttagggccaccaaaatccaattcattggccgcttttttacaacgcaaaaactggaaaaaccctggggttccccaatttaatccccttgcagaaaatcccctttttcccaattggggaaaaaccaaaaaggccccccccgatcgcctttccaaaaattttcacaccctgaatggcaaatgggaccccccctttaacggcccattaagcccggggggtttgggggttaccccc

SEQ ID NO: 82895 - DNA, 450 bp, Zea mays
  Clone ID: LIB3114-050-P1-K1-B3
aaaaaaaaaaaaaaaaaaaaaaaaaaaaaaaaaaaaaaaaaaaaaaaaaaaaaaaaaaaaggggggggggaaaaaaaaaggaggaaaaaaaaaaaaaaaaaaaattatcattaaaaaaaaaaaataaataaaatattttaaaaaaaaaaaaatggccccccctttttaaaaaacccaattttacttccccctttttccaacttatattttttttttttttccccccaaatttaattctttccccccctttttccccccctttttttttaaaaacccttggtttcccccattttataccctttcaaaaaaacccctttttccccatttggttattaaaaaaaaacccccccccctttcccttttcccaaaaatgtccccccttttttttcaatttgcccccccctttttccctccttttaaccccccgggttttttttttttccccccctt

SEQ ID NO: 82896 - DNA, 449 bp, Zea mays
  Clone ID: LIB3114-050-P1-K1-B4
gaaaaataatatttttataaaataaaaaaaaattaaaaaaattaaaaaaaaaaaaaaaaaaatgaatggtggaaaaaaaaaaagggggaaaaaaaaaaatggcggcctttttaaaatatccaattttacattccccttctttcaacataataatttttttttttgttttccctaaattcaatttatttccctctttttaaaaacttttttttttgaaaaaccctgattttcccaaacttaatcccctttcaccaaatccacctttctcaattttctttatttaaaaaaatccccccactaaacccctttccaaacattttcccaatctaatttcctaattgaaccccccctttactctcccataaaacccgccggtttttttttttactctcaacttaaccttttcattttcaacccctctaaccccttttttttatttttttcctttc

SEQ ID NO: 82897 - DNA, 568 bp, Zea mays
  unsure at all n locations
  Clone ID: LIB3114-050-P1-K1-B5
catttaatttatatatcttaatttttaaatatattnntnnnttttttcttttctcttacaatacctatccnaaattcccaattcaacccatcgtccgaaaaaaaattaaataaataaaaaaaaaaataaaaaaaaaataaaaaaaataaaaatataaaatattttggttaaataaaaaataaaataaaaaaaaaaaataaaatataattttctttctttttttattaataattattataactttctattttttttatttcttataattttttattattttaaaataattacttttaataaaatattttaattaaaaaatctatttttaaaaccttttattttcccatattttaattccttttatttaaaatcttttttacctatttattatatttttaaaaaatccccctattttatttttttttaaatattattacttaatctaaatctctatttataccttcatttttttccccctctattatatttatttttattttttacctttttacttattttttattttatttacttaacatttattttttcaatatattttttatttttt

SEQ ID NO: 82898 - DNA, 265 bp, Zea mays
  unsure at all n locations
  Clone ID: LIB3114-050-P1-K1-B6
ccggaattcccaagtcgacccactcctcccaaaacaaaaaaaaaaaaaaaaaaaaaaaataaaaaaaatatacatcattcgtcaannancgtgcttgtttaaacataaaattccgcttacataaaatatttattttttattacctaaattcatttctaattccctccttttccaaccttttaacttcttatttccctcccttttcctcaacttattccccttttttcaaattcccctttcttctcctttcctaattattaactaa

SEQ ID NO: 82899 - DNA, 82 bp, Zea mays
  unsure at all n locations
  Clone ID: LIB3114-050-P1-K1-B7
ctttacgcctgcagtacccatcccnaattccctgtcgacccactcatcctactaattctaaatcaacaaactaacaatctaa

SEQ ID NO: 82900 - DNA, 457 bp, Zea mays
  Clone ID: LIB3114-050-P1-K1-C10
aaaaaaaaaaaaaaaaaaaaaaaaaaaaaaaaaataaaaaaaaaaaaaaaaaaaaataattgctaaaaacttatatagtggcatactacctaatcatcacctgtttgtcattcaatagctcctcttttttttccccccccttcccattatttcagttttttttatatccacctaatttaatttctctgccccatcttttttccaccattttaattttaaaaaccctttccttccccatcttatttcctttacaaaataattcccctttctctcgttctctttaaaacaaaaaacccccccccttttaccctcccctatatgtgtcaatctttattatctaattttccctccccttttcctccccatttaacccctcttcctttattttttcccctcatttccctcctttttttttttccctttctcttttcctcccttcttttcttttttttttctt

SEQ ID NO: 82901 - DNA, 211 bp, Zea mays
  unsure at all n locations
  Clone ID: LIB3114-050-P1-K1-C12
gcctgcagtaccnntccanattggggggggagggagcgtccgaaaaaataatactataaggtggaaaagataattattatatttacgattcatcctggtcgggaacattaagaagtgtgagatagactgaacaaaaggtggggagaggatcgacagatactggagttgacaagtgtattttatacctgataaatcaaattataagtttctg

SEQ ID NO: 82902 - DNA, 421 bp, Zea mays
  unsure at all n locations
  Clone ID: LIB3114-050-P1-K1-C3
acgcctgcagtaccntccgaattcccngggggggacgcgtccggccgtcgccgccacggccgccgcagatggagctcttctgcgcgccgtaccaaggtggcgggcgggcgcaacagctgagggtgatgtagcctggcctcccttctgctgctgatcagctgattgatactactattcagacgcactaatttataggggataatatacaacatcttagcaggaaaaaagggggatggtgcgaaaaaagaaaaagaaagggagatgcataagggtggggtttatttatacactcaggaaataggggtatgcatgggaccagaggggactaaactggangccactggtatttagagggagagcccttttggcaatgcctacgggtctaactctggctcatcttcaatctctatcaaacgggtat

SEQ ID NO: 82903 - DNA, 135 bp, Zea mays
  Clone ID: LIB3114-050-P1-K1-C5
ccaactacttctaaaacgcaagtcttctctctacaatacccaaacttacggacgcgtgcatacaacatgtgggtgtatctatacctacacctaaattcaaatcatctaccttatactaatattcacaccccctaa

SEQ ID NO: 82904 - DNA, 281 bp, Zea mays
  Clone ID: LIB3114-050-P1-K1-C7
cgcctgcaggtgccgggccggaattccccggtcggcgcacgcgtccggtccggttttttattgtgcaggaatagctaatatgataatgataataattacgtttgtaatctctccgaggggggggaaaaaaaaaaaaaaaaaaaaaaaaacaaaaaaaaaaaaaaaaaaaaaaaagcgaaaacaaaggggggccgcgcggaggggaacaagcgtaccggacccgggccggcgcccgccaaggcgctcgctgtgcggggccctacatcacaaactactggggg

SEQ ID NO: 82905 - DNA, 303 bp, Zea mays
  Clone ID: LIB3114-050-P1-K1-D10
aaaaaaaaaaaaaaaaaaaaaaaaaaaaaaaaaaaaaaaaaaaaaaaaaaaaaaagggagggcgaaaaaaaatattgggtggtccaaaatataaaactttatcttgcccccctctttaaattttcctaatttcccttcccttcctttcaactgcatatctttttttttggtccccctaaattaaatccactgcccgccgttttacaccttcttaactggaaaaaccttttctttacccaatttaatccccttacaccacatccccctttctccactttcctaattaccaaaaattcccccccc

SEQ ID NO: 82906 - DNA, 265 bp, Zea mays
  Clone ID: LIB3114-050-P1-K1-D11
acgcatcctaaataaaaaaaaaaaaaaaaaaaaaaaaaaaaaaaaaaaaaaaaaaaaaaaaaaagggagggtggaaaaaactaggggggggagaacactactaaatataaaaaaaaaactttattaaaataaattcaaactatcaaataatcgcggcgccactataacaatccatatcatctcccctcttattacaaagaaaatatttttttttttacaccccttaatattatttcttctcgccccttttaaaaacaactaactc

SEQ ID NO: 82907 - DNA, 406 bp, Zea mays
  unsure at all n locations
  Clone ID: LIB3114-050-P1-K1-D12
tggtacgcctgcaagtaccggtcccgaattcccgggggggcggacgcgtccgactcctaatatatagtagtgagtgactaggtggtatgtgtaggactgtactatgttttcgccatatgcatggtgggcgcagcgcgtaatgaatgtaatggcagtactgctactacgtgctctgctacttccaaaaaaaaaaaaaaaaaaaaaaaaaaaaaaaaaaaaaaaaaaaaaaaaaaaagggcggtcggtataggggggccgggggaaaggaaaacgggcatgggaaggaaaaaggnggaaaaaagggaaaccaaaaataaaattaaataaaccagggggggccaccgttaaaaggagaaaaaaccctgggggggcccaaccaaaataaagtttttttaaatgggcactt

SEQ ID NO: 82908 - DNA, 172 bp, Zea mays
  Clone ID: LIB3114-050-P1-K1-D2
attcccgggtcggcccacgcgtccgaaaaaaaaaaaaaaaaaaaaaaaaaaaaaataaaaaaaaaaaaacaaacaaacacaaacggggcggcgtcataaacaggggcctagcttacctccactttcattccaacttcctaacttttttataccgttccccaaattcaaccct

SEQ ID NO: 82909 - DNA, 179 bp, Zea mays
  Clone ID: LIB3114-050-P1-K1-D4
cgtgcgaactaaaaataaaaaaaaaaacaaacaatataaaaaaaaacaaacttacaaacaacatacggggggggggataaataagggggggggggggggcggcccttttaaaggatccaagcttactaccgcgtgcatgcaacggaataccttttttataggggaacctaaattcaatt

SEQ ID NO: 82910 - DNA, 362 bp, Zea mays
  Clone ID: LIB3114-050-P1-K1-D7
cgcctgcaggtaccggtccggaattggcgggggggcgcacgcgtccgcacgtacattaaggagatgaggtgcaagtacccccacaagcacatctcgtgtcaagcagcgcgccatcgcccacgatggggccgttcacgctggacgtgttcatctccaagcgcttcgtctcggcgtccctcacgcaccggtcgacctggaagcaggtcgcgggcgccgggaccaactccatggacatgaagggggggctcatgtcgaggtgcggcattcacgcctggttggccagttgggggagaactaactttgtggtcctgtgctttctgttatgatactttaattcttcctcgtaggtcatgggggggggg

SEQ ID NO: 82911 - DNA, 206 bp, Zea mays
  unsure at all n locations
  Clone ID: LIB3114-050-P1-K1-E11
tgtacacctacaataccantccagaattcccggggggggcgcacgcgtccgaactaaatataaataaaaaaacaaacaatataaaaaaaaacaaacttacatacacatgcggggggaaaaaataggtggggggtattaataacccaaatttacttacccgtccatgcgacgacatagttgttatatagggaaacctaaattaaatc

SEQ ID NO: 82912 - DNA, 394 bp, Zea mays
  unsure at all n locations
  Clone ID: LIB3114-050-P1-K1-E2
acgcctgcagtaccntccgaattcccgggggggggcgcgtccgccgtctctccccagctccgatgccctgcgactcaagccatgtccagccggtcaagtcccgggcagccatagtccggaccctgaagaacggaagtgtagtcgaacactggtttggtttcttctgctaatcaagggctcctgcatcgctgacatgctgatgacatataccagcaggggaaaacgacgggtaaaccttttgactccagataggaatggtgggaatagcttacctcccctgtgttttctggcgcaccatggtgtaacggagttgctagagcgcgactatagattgcgcttcctgcctgcctgtctcgcccgacatcgtatagaaataaaaccaataattcgcatc

SEQ ID NO: 82913 - DNA, 266 bp, Zea mays
  Clone ID: LIB3114-050-P1-K1-E5
aaatataaaaaaaaaaaaaaaaaaaaaaaaaaaaaaaaaaaaaaaaaaaaaaaaaaaaaaagcgaccgtgatataaaaatccaggcatacaaacacaaacatactaacaacaaaacttttttttatctcactcctaaatcccatccactaacccaacttatccaactttgagcccccccatccccattgcttcccccatcttatcccccctctcacccccttactcctttttctatactttccccataatctaaatttccctcccc

SEQ ID NO: 82914 - DNA, 367 bp, Zea mays
  unsure at all n locations
  Clone ID: LIB3114-050-P1-K1-E6
aaataaaaatttntatattaaaaaaaaaaaaaaaaaaaaaaaaaaaaaaaaaaaaaaaaaaggaggttgaaaaaaaaaaaaggggggataaaaaaaaaaaataaaaaaattataaaaggccgccctttttaaaaaatccaaatttacttccccttccttccaaattaatattttttttatagtcccacttaaattaaattcattggccgtcttttaaaaacgtctgaactgaaaaaaccctggctttcccaaattaaatccctttcaacaaaatccccttttccccagttggcttaataacaaaaaggccccaaccaatcgcccttccaaacatttgcccaacttaattggcaaatggaacccccct

SEQ ID NO: 82915 - DNA, 272 bp, Zea mays
  Clone ID: LIB3114-050-P1-K1-E7
caaataaaaacttacataaaaaaaaaaaaataaaaaaaaaaacaacaaaaaaaacgcgtgggggtcaaaaaagggggggggaactaaaaaaaaccaatatatatacatacattaactcttccttcccttttaactcatcttcacttctctctccctttcccttcatctctcccccctctctcatatcgcccccttctcttattttcctcccctccctttttcctcccccctctcttctcctccccccttttcttttccctcctccttattcc

SEQ ID NO: 82916 - DNA, 316 bp, Zea mays
  Clone ID: LIB3114-050-P1-K1-F10
tcttacaaaaatataataatcaccaactctctcaactgtatcaaaccaatgcgacaaccagcgcgcggtctaaatgtacgatgtgacaagcaaaaactagaccatatttccccctcctacttaattcacctacttcattttctccaatacctcccttcatatctcataaaacctaaatattttttcacctatacataccttcattatctatcaaaacacataaatgctacttctactactaatactattacggtaaaaccaactttatttccaaccaccattgctttataatattaacacttttacttccacatct

SEQ ID NO: 82917 - DNA, 178 bp, Zea mays
  Clone ID: LIB3114-050-P1-K1-F11
gcgtccgaaaaaaaaaaaaaaaaaaaaaaaaaaaaaaaaaaaaaaaaaaaaggaaaaaaaaagggggcgcgggaaaaaaaaggggggggggggaagggcctcctttctaaatgttccaaccttacgtactcgggcatgcaacgtgttaatttttttataggggcacctaaattcaatt

SEQ ID NO: 82918 - DNA, 257 bp, Zea mays
  unsure at all n locations
  Clone ID: LIB3114-050-P1-K1-F2
cgcctgcngtacccgtccgaattcccgggggcgcacgcgtccgggacaactgattgatggctccccgtcttcctcacccggtgcgtggtcaccggtccaggtgacatttgccctcttgaatggaatcgagactctgtctgttcgcattgctctccaggtgttcggttaatgttcggaatggaaaatgtacaattactactacttcacgagatagggtcttggtgatcatgggcccccaaatacaatgtgctttctgc

SEQ ID NO: 82919 - DNA, 181 bp, Zea mays
  Clone ID: LIB3114-050-P1-K1-F3
cgccacgcgtccgaaaaaaaaaaaaaaaaaaaaaaaaaaaaaaaaaaaaaaaaaaaaaaaaggccaaatccatcgggcggcgggcaatcttacgggggcgtgcatagctaaatcttagctcttttctacccaaacctaaattcaattggctggcgcgggaatacaacggccggactgggaa

SEQ ID NO: 82920 - DNA, 333 bp, Zea mays
  Clone ID: LIB3114-050-P1-K1-F5
aaataaaaaaattctttaaaaaaaaaaaaaaaaaaaaaaaaaaaaaaaataaaaaaaaaaaggaaatgtgtaataaaaacacgggggtactaacaaaaaaaaaattatataatataaaccaaaaaataattgggcgggcctttttaataaaacaactttatctccccaatccttctcttttctcattttttttattcttgccctatattcatttttcttcccctgttttaataaccttgtggcctgaaaaacccttgcttttccccatttaattcctctttaaatacttttccttttcccccttttttttaaaatcaaaagggccccctcttt

SEQ ID NO: 82921 - DNA, 306 bp, Zea mays
  Clone ID: LIB3114-050-P1-K1-F8
aaataaaaataaaataaaaaaaaaaaaaaaaaaaaaaaaaaaaacaataaaaaaacggggagggttacatacacgtgcggtgcaaaaaaaaaactttttttttttttaacctaaattcatttctctccccttttttttacaccatttatttttttttaagcccctctccattacccatctttttccctttttatcaaattcaatttttggcaaatctttttataaccctaattttttaacctttcgccctttccaacttttctccttttaaaaatccactggtttcccccctttatcttcttttta

SEQ ID NO: 82922 - DNA, 307 bp, Zea mays
  Clone ID: LIB3114-050-P1-K1-G3
gcgtccgaactaaaaaaaaaaaaaaaaaaaaacaataataaaaaaaaacaaacttacaaacaaaaaacgggggggggggtaaataaggggggggggggacctaaaattaaattcactgaacatttggtttacaacatattaaagtgggggcacctttgcaggaccccaacttaattgccgtgcattacaaggtgctttttttttttttgggtaacctaaattaaatccccgccggtcgtttttacaaacaggggtggggaaaaactggggattccacaatttatgtttttggaaataaatccccttt

SEQ ID NO: 82923 - DNA, 270 bp, Zea mays
  Clone ID: LIB3114-050-P1-K1-G5
ggtgatgaaaaaaaaaaaaaaaaaaaaaaaaaaaaaaaaaaaaaaaaaaaggaaaaaaaaagggggcggtggaaaaaaaaagggggggggggggaataaaaaaaagggccccccttttaatagaggccaacccttccatgcggtgcatgcaacttgataggtgttttatagggggacctaaattaaattcaccggcctgcgtttaacaacggcggggctgggaaaacccgggggggaccaaaataaatggccttgaaaaaaaaccccctt

SEQ ID NO: 82924 - DNA, 393 bp, Zea mays
  Clone ID: LIB3114-050-P1-K1-G7
gtttgccgggctcaccagctggtccaggaaggcttaaggggggggtccaagagaggggcgtggtaactgtgtggtctgcacccaattattgctacagatgtggcaatgtagcttctatattaagcttcgatgagaagatggaaagagatgtcaagttcttcacagagacagaggaaaacaaccagatgcgaggcccaaggactgcagtcccatatttcctctgacttcaattgtacattttagaagtcaacatttaaatctgtaagggctaaagatcagtcagatgtggtgattattggaggttcacatcatagtgcaatcttatgcattggatttctctttgtctgttaaccatatgttcaatagaccattcggaggttcatgctactgtat

SEQ ID NO: 82925 - DNA, 449 bp, Zea mays
  Clone ID: LIB3114-050-P1-K1-G8
cgcgtccgaaaaaaaaaaaaaaaaaaaaaaaaaaaaaaaaaaaaaagggaaaaaaaaaaaaaaggggggggggaaaaaagggggggggggggaaaaaaataccaaacttacctacccttgcttccgacattcatattttttcttttgagatacctaaatttaattcactggcccgcctttaacaactttggggaattgtaaaaccctggcttttcccaacctatatcgcttgctacaaatccccctttcccgctgttgcctataatccaaaaagccccgacctttctcctttcccaaaactctcccccccttaatggcgaaggggaccccgcccttaacgcgccaataaaccctgggggggtgggtgatttcctccaatctaaactcctacccttttccagcgcccctaccccccccgctctcttctctttttttccctctcctttttt

SEQ ID NO: 82926 - DNA, 354 bp, Zea mays
  Clone ID: LIB3114-050-P1-K1-H1
aaaaaaaaaaaaaaaaaaaaaaaaaaaaaaaaaaaaaaaaaaaaaaaaaaaaaaaaaaaaaaaaaggggaaaaaaaaaaaaaaaaaaaaaataaaatacacataaataaaaaaaaaaaaaatatattataataaaaaaataaaaaaaaattaattgggggggggccttttttaaaaatccctttttaacccccgttttttttcaaacttttttttttttttttgccccccctttttaaatttcgggggcggtgttttaaaaccccggttatttaaaaccctctggcttccccaatttatttttgtttaataaaaccccctttttgcccgggtgttaataaaaaaaaagggcccg

SEQ ID NO: 82927 - DNA, 377 bp, Zea mays
  Clone ID: LIB3114-050-P1-K1-H10
aaataaaaataaataaaaaaacaaacaatataaaaaaaaacaaaaatacatacacgtacatgggaaaaatataactatgggggtcgcggcatctaaatgctctacgctggccgcccttctactaacgtcgtgactgtcttatcccttgcgttccccatcttattcggtcgttgctgcactttctactttcgccattgtggatcctatgtaataggcccgctcctatctcttttaccaacaccccctcttcctggatggcgaatggcactcgacctgcacaccgacattcattcccacctgtgtcgcgattacactcaccattgccacttcccttgccactgccctataaccttgtcctttcggttggttaccttcat

SEQ ID NO: 82928 - DNA, 212 bp, Zea mays
  Clone ID: LIB3114-050-P1-K1-H3
atgattgataactaataattaaggctactagatgatcgttgagatgtttcttcttcttcttcttgctcctcctcttgccgctgttcatatagctggatggatcaggacttgtgctgatcggtcgatggattccatccatgtgtactcgtctgctgttctttccttcccaattcccatgttccaatggagtctggattcattaaaaagaacaa

SEQ ID NO: 82929 - DNA, 327 bp, Zea mays
  unsure at all n locations
  Clone ID: LIB3114-050-P1-K1-H5
agctcaagaagaagctctgtccgtacctgtacccgccgccgccgtgctccggtgcctgtggccgggggccgtcgccgtcgatgtttctgtgcgagccggaacagccagcgggatgccacatcatgtgacgatgaagtgaagctccgtgaataatcgtcccgtccgaacttgtgcacatgcgtggttgtggttttgctttggcatctgaattacaatcctaagtgatcatggaatttagatcactacttatatataaagtattgctttgtgagtttgtttttaagttaagatgttctaaatgcgaccaacanngagaccactacactt

SEQ ID NO: 82930 - DNA, 97 bp, Zea mays
  Clone ID: LIB3114-050-P1-K1-H6
tttacacctccagtacccatcccgaattcccgggtgcccgcacgcattcaaactaattctataaccaaacctgcccctctagacgatccactcttac

SEQ ID NO: 82931 - DNA, 417 bp, Zea mays
  Clone ID: LIB3114-050-P1-K1-H7
aaaaaaaaaaaaaaaaaaaaaaaaaaaaaaaaaaaaaaaaaaaaaaaaaaaaaacggggtggggaaatacaagctaacatacccttacatacaaaaaacatatcttttttctcatgtcacctaaattaaattccctggccttcaatttacatctttttaattgggaagcccctgtctttaccaaacttaatttccttccacctcttttcccgttattatcttttttttttttatccactaattccatatcttttcgccctttttaacacccgctcaatctgaaaaacccatgtgaccccccctttttctcccctttaatcccttcccttgttttcgtttcgctcatttttaaaatatcactctctcatctccctttctccaagttttttccccttttttcctttttttctcccccct

SEQ ID NO: 82932 - DNA, 189 bp, Zea mays
  unsure at all n locations
  Clone ID: LIB3114-050-P1-K1-H8
ataaaaaaacagccgcgcccactcgtacnaactacacacaaaacaaccaattcttatttcatttctcaaaaaaactaacataactggtcttgctaatattcaaaaaccttgatgcccccaataaaattcaactttcatcattaactcctccacataaaatcaatttcccctaacctccattattacacc

SEQ ID NO: 82933 - DNA, 103 bp, Zea mays
  unsure at all n locations
  Clone ID: LIB3114-010-P1-K1-A4
tttttccgtttcttggttacttaattcnttggcttcggcggtcgggtgtgggaacgcgattacctcactaaaaaggcggtaatacggatatccacagaatcag

SEQ ID NO: 82934 - DNA, 320 bp, Zea mays
  unsure at all n locations
  Clone ID: LIB3114-010-P1-K1-B11
ggccaaggttgcctacgagaggaagaagcaattggccaagctgcgtgtcaaggccgagaaggcagccgaggagaagttggggtctcagttggagattcttgcccctatcaagtactgaggagctgtgctttgtcatcagttttggggaacatctagtctttgttttaagtgttcggtaacagtttgtgacagtataatctggtaaaccgtgttatttttctgccactcctatttgaacacattttctagctggtgaatgaactgtttggtcgatcttaaaaaaaaaattaaatttttgtaaaaannnnnnnatataatta

SEQ ID NO: 82935 - DNA, 467 bp, Zea mays
  Clone ID: LIB3114-010-P1-K1-B12
taataaattcagtcttctatagtaaaaaaaaaaaaataaaaaaaaaaaaaaaaaaacaaataggggaacctaaaaaataaagaaaagaaaaaaaaaaattaaaaaaaactaaaaaaaactgggggcggccgccttagagatcccaactctcctaccccttgatgccctctttaaacgttctttttcgggtcccctaaattaaataccctggccctcttttaaaaacttcatgatcgtaaaaaccctcgttttcccaaatttaatcgacttgctgcaaatcccctttacccaagttgtcttattagcaaaaaggccccccccgttcgcctttccaaaaagttgcccagccttattgcctaatgggcccccccctttaacgcccctttaagcccgggggttgttttttttccccccaaattaacctttacatttgcaaggtcctttagacccgtttcttttgttttttt

SEQ ID NO: 82936 - DNA, 56 bp, Zea mays
  Clone ID: LIB3114-010-P1-K1-B2
tcgaaaaaaaaatataaatttaaataggccctctaatatataaaaatcctaacctt

SEQ ID NO: 82937 - DNA, 245 bp, Zea mays
  Clone ID: LIB3114-010-P1-K1-B4
agcccgatggctcggggacacagtgcttgatggtaaagatcaaatagcaaagccccccgaggtctgctgccccatgtccctgtgagcgagctcgtatcatctggggactgtggacccatcgacggttgtacatatcatgcacttgtgctcgtgcctatgtaaagtagtaataccaactcaactctgatcttcatccaagtaccgaaatgattaaaagatcagatgtgaaaaaaaataaattaata

SEQ ID NO: 82938 - DNA, 174 bp, Zea mays
  Clone ID: LIB3114-010-P1-K1-B5
aaataaatataaaataaaaaaaaaaaaaaagggcagccgatctaaaagataacaaacttacatgcgcgtgcgtgcaaaaaaaatagatcgttcgttggcgtcacctaataacaagtctaatggccgtctattttacaatcggcgtgactgttaaaaccttgacgttacccaact

SEQ ID NO: 82939 - DNA, 69 bp, Zea mays
  Clone ID: LIB3114-010-P1-K1-B7
acaacaaactatatatgttgcataaaaaaaaaaaaaaaaaaaaaaaaaaaaaaaaaggaaagggaaaaa

SEQ ID NO: 82940 - DNA, 283 bp, Zea mays
  Clone ID: LIB3114-010-P1-K1-B9
aaaggattctggccatcaacagaatgggaaggcaaaatctaaccaagaagaaaacgaggactgcaaaaacgagaaggataaacccttgtcgtagttcgttttctacgacaaaaaatgaatcctaatctttgtcggatatctatttgtgctcttgttgggagtcttttcagttattgttccaactattattaatatatgtacatgcgtgggacctttgcattgtattaatcaattttcagaaattaaagagttttttccttattttttataaatcttttttttt

SEQ ID NO: 82941 - DNA, 296 bp, Zea mays
  Clone ID: LIB3114-010-P1-K1-C1
cccccccccctttttttttttttttttttttttcaaagaaagcttatgaaacaattcttaaataaaggtgctaataagctttgtggaaaaaaaaaatagtgttcgagtccttagtatagagggtgctcttagatgtcagatttctcctgtccgactaccatgagtttaatgaatttggtgctgatggaggaccatcagctaaagcccttcggaccaaattcaacgtgtttgtcaaaaaatgtatctgctcatctgggagtagcttgtgccacacatttagttgaaacatgtgattg

SEQ ID NO: 82942 - DNA, 88 bp, Zea mays
  Clone ID: LIB3114-010-P1-K1-C3
aaaaaaaaaaaaaaaaaaaaaaaaataaaaataaaataaaaataataaaaaaaaaaaaaaaagggggggggaaaaaaaaaaaagaggg

SEQ ID NO: 82943 - DNA, 387 bp, Zea mays
  Clone ID: LIB3114-010-P1-K1-C4
aaaaaaaaaaaaaaaaaaaaataaaaaaaaaaaaaactaacactcaaaaaaaaaccaaaaaaacgggcacggggcaaacaaaaaaaaaagaaaataaaataaatatacctaacttgtcttcccttttactgcttccaacctccctcccccgtgcttccccccttctttctcttaacatgtttccccataaatcatttccctgtcctctttttaccaatcggctccactagaaaaacccctgggctcccctaccttaaattcctcacaccccaatcccctttttgccccctcccttattaccctaattacccttcccttttccccctcccatctttttcccatccttattgtttaattgtcccttccctccaactgccctttaatctc

SEQ ID NO: 82944 - DNA, 195 bp, Zea mays
  Clone ID: LIB3114-010-P1-K1-C9
aaaaaaaaaaaaaaaaaaaaaaaaaaaaaaaaaaaaaaaaaaaaaaaaaaaaaaaaaggggaaggggaaaaaaaaaaataaaaaaatagggccgtcctctttaaaagatccaagcttacttacgggggcctgcaataaaataccctttttatagcgccacctaaatcaaataaactgtccttcattttacaacct

SEQ ID NO: 82945 - DNA, 253 bp, Zea mays
  Clone ID: LIB3114-010-P1-K1-D1
ggaagtactccggtccggtccggtcctgtgtgagccttatgtacgtgcaattttaatgtctgttgatattacacgaaaaaaaaaaattaccttatcggtacccaattatagcatatcatgcagtgtcggctcagcatggagaactgccaatgccccagaagcaaaaactggggctgcttctttaaggggtcaagcttaacgtagcgggtctaccgatcaaatagcttttataaggggatgccaaattaaatta

SEQ ID NO: 82946 - DNA, 186 bp, Zea mays
  Clone ID: LIB3114-010-P1-K1-D10
aaataaaaaaaaaaaaaaaaaaaaaaaaaaaaaaaaaaaaaaaaaaaaaaaaaaaaagggagggggaaaaaaaaaaaaagggcggtgattaaaaaaaaaggggcggctgttctagaggacccaagcttacatacccttgcatgcgaggcaataacttttttataggggcacctaaattaaatacat

SEQ ID NO: 82947 - DNA, 60 bp, Zea mays
  Clone ID: LIB3114-010-P1-K1-D11
aaataaaaatagttaaaaaagcaaacaaaataaaaagattaacaagcttacaaacacaat

SEQ ID NO: 82948 - DNA, 320 bp, Zea mays
  Clone ID: LIB3114-010-P1-K1-D2
aacacatggttgatcaactgacagaacttcagaaaaaagaacaaatgttttgtgaagcaaataagtgtcttcgaagaagactggaggagagcaaccaggttatatggcagcatgcgtgggagcaaagcgagcggcattctgaagtgcagccgcagcagctcaatggcaataacttcttccatcccctcgatggtgctggtgaacccacccttcagatagggtatccttcagaggcactgactagctcatgcatgaccaccttcctgcccccgtggttgccatgagatcgaactactgcgcaattccgaattaataagcat

SEQ ID NO: 82949 - DNA, 61 bp, Zea mays
  Clone ID: LIB3114-010-P1-K1-D3
cccacgcgtccgaaaaaaaaaaaaaaaataaaaaaaaaaaaacaaaaaaaaaaaataaaaa

SEQ ID NO: 82950 - DNA, 135 bp, Zea mays
  unsure at all n locations
  Clone ID: LIB3114-010-P1-K1-D5
tacagatgtatatcagaggttatgtaaattatccccctgatgtagtcaaccagaacaacttacagtgagatcttgtaggtgttgaatgtaatgtatcattctttaattcccccccccccccncnttttacttcgg

SEQ ID NO: 82951 - DNA, 443 bp, Zea mays
  unsure at all n locations
  Clone ID: LIB3114-010-P1-K1-D6
tacagatgtatatcagaggacatgtcaattatccacatgtagtaggagaggaggccccctagggcagagaccttgtgggtgtcgcgtgcgccggatcacattatcttcaagggagcgccgccctccaagaagccaaagtttaggtgaatgctgtcttcggcaattcgctcgtgccaaagtgcagcagcttcaagggagcaccaccttcaagaaggcagctctggttaatgggactccttgaagctttggcccccggagtagacgtgtctgtaggagtgtggtttgttatatctagattatctgcagtagcttagtccatctaaattaaatgtgacagctgaactttggaagtcgcntcattggggaaacgaaatttaagtctattgatttgttaatgccctcagttatgtattatttcccttagtccggtgattttccggtct

SEQ ID NO: 82952 - DNA, 81 bp, Zea mays
  Clone ID: LIB3114-010-P1-K1-D7
gactagttctagaaaaaaaaaaaaaaaaaaaaaaataaaaaaaaaaaaaaaaaaaaggggggggggtaaaataataaaggg

SEQ ID NO: 82953 - DNA, 270 bp, Zea mays
  Clone ID: LIB3114-010-P1-K1-E10
gacggtcctcgaggatgctgacgcaatgtgatttctgctcagtgctctgaatgttgtcagcataaattaggtggttatccctaatcaggatattaagttgcaaagataattgaattaataaatgttgtaccgtgcccgatgtgttaaataaataaaatagaaattaaaaaaaaaataaataaaaatgaagaaaaaaaaaaagaagaacaaaccgatattaattttataacatgtgctcatcacttaattgctaatgggacggctccttgt

SEQ ID NO: 82954 - DNA, 214 bp, Zea mays
  Clone ID: LIB3114-010-P1-K1-E12
agatatcaagatagcaacagtgttgaagttgggctgtaagttcttaggttgagaaggtgtgagagctgagctttttttttttcaatttacatgtgtggtatgttgtatatgagacaggtttttttcctgcttgccgtccagattataaccttggttgggcctgtttaaaaaaaaaaaaaaaaaaaaaaaaaaaaataataaaaagataaaataa

SEQ ID NO: 82955 - DNA, 267 bp, Zea mays
  Clone ID: LIB3114-010-P1-K1-E2
aaaggattctggccatcaacagaatgggaaggcaatatctaacccagacgaacacgcgcactcctgcgacgagaatgataatacccttgtggcacctaaatttataccactgaacatgaattcacaacttcgtgacagatgaatccctgccgttgccgagagtaatttcctctcttgacatacccattatgactatatgtacattcgtgaaaactatgcattgtaataactctatcctcagaaaataaagactatttgtcctatttt

SEQ ID NO: 82956 - DNA, 100 bp, Zea mays
  Clone ID: LIB3114-010-P1-K1-F7
gactagtcgtagatcgcgagcgtccgatctacaggatacaagcttacgtacacgcggatgcggcgctatatgtctattatagtgtcacctaactgcaatt

SEQ ID NO: 82957 - DNA, 192 bp, Zea mays
  Clone ID: LIB3114-010-P1-K1-F9
aaaaaaaaaaaaaaaaaaataaataaaaaaaaaaaaaaaaaaaaaaaaaataaaaaagggaatgggggaaaaaataaaaaagtttaaaaaaaaaaaaaaaaaatggggggggccgttttaaaggatccaagtttactaccccttccatgcaacatattaacttttttatagggccaccaaaattaaattaat

SEQ ID NO: 82958 - DNA, 151 bp, Zea mays
  Clone ID: LIB3114-010-P1-K1-G1
cccacctcgtctgtggcgtggggcgctggagcccggtctggttgggttgggaagccctttaaactgtggtcacttgcattttaccttttccatcgctgtttattgtgagtggtcctatatcaaaaaaaaaaaaaataataatgataatata

SEQ ID NO: 82959 - DNA, 390 bp, Zea mays
  Clone ID: LIB3114-010-P1-K1-G2
aaaaaaaaaaaaaaaaaaaaaaaaaaaaaaaaaaaaaaaaaaaaaaaaaaaaaaaaaaaaaaaagagaaaagaaaaaaaaaaaaaaaaaaaaaaaaaaaaaaaaaaaaaaaaaaataaaaaaaaaaaaaaaaaaaagggggcgccccttttaaaggaccaaattttacttccccttccttgcaaaaaaaaactttttttttggggcccccaaaattaaattccctggccgggttttaaaaacgccggaattggaaaaaccctgggttacccaaatttaatcgctttgaaaaaaatccccttttccccaggtgggtaaaaacaaaaaagccccccaccaatcccctttccaaaaattggcccaccctaattggcaaatggccccccccctt

SEQ ID NO: 82960 - DNA, 275 bp, Zea mays
  Clone ID: LIB3114-010-P1-K1-G4
aaaaaaaaaataatttaaaaaaaaaaaaaaaaaaataaaaaaaaaataaaaaaaaaaagccagggggtgggaaaataaaaaaaattacggaccgcctcttacaatcataacacttcttatttagtaggggccgaaattctataacctttccgtttgtcaacaatataagtggctgggaaacccctttttttaccctttttaatagtttttcacctcccccccctttcaactgttggaataataaaaaaataggccatcaccaattgcccttccca

SEQ ID NO: 82961 - DNA, 209 bp, Zea mays
  Clone ID: LIB3114-010-P1-K1-H5
tactatttttagttcgtctgcggtcgctctagatgatccatgcttacgttcgcttgcatggggcggggtagctctcctatagtggcacttaaattcaaattcactggccgacgtataacaactatctgatctggtaatccttggcgttactcaacttaatagcctttgtgcacataaaactttctacagctgtcgtattagcgaagagg

SEQ ID NO: 82962 - DNA, 97 bp, Zea mays
  Clone ID: LIB3114-010-P1-K1-H7
ctgcagtaccgttcttgaattaccagatcgacccacgcgttcgaaaaaaataatatataaaaataagtaaaaaaaaaataaataaaaaatttaaaaa

SEQ ID NO: 82963 - DNA, 260 bp, Zea mays
  unsure at all n locations
  Clone ID: LIB3114-016-P1-K1-A1
ccacgcgtccgagcatgccactgggtttgtccaaggtgccctgaagcgtgatgagttttgtggtttcatcatggggccgtccaacgtaaaaacagtatggaggtatatctaccaccacctgatgatttgatgaaccacaaactggcgtgggtaggttgtaaatgacagcaaatgttattgttcttagggacaatgtgaatatttggttttgcacggctnaaaaaaaaaaaaaaaaaaaaaaaaaaaactaacaatataaa

SEQ ID NO: 82964 - DNA, 138 bp, Zea mays
  Clone ID: LIB3114-016-P1-K1-A5
gcagtaccgtaccggaattcccggttagaccacgcgtatcggactagttgctagaatcgcgagcaggtcgcttctagaggtatccatagcttacgtgacgcgtgcatgcggaggggggtgagcttttctatagatgtc

SEQ ID NO: 82965 - DNA, 260 bp, Zea mays; identical to SEQ ID NO: 82963
  unsure at all n locations
  Clone ID: LIB3114-016-P1-K1-A7

SEQ ID NO: 82966 - DNA, 77 bp, Zea mays
  Clone ID: LIB3114-016-P1-K1-B6
tccggaattcccgggtcgaccacgcgtccgaaaaaaaaaaaaaaaaaaatagaaaaaaatataaaacaaatcaaata

SEQ ID NO: 82967 - DNA, 473 bp, Zea mays
  unsure at all n locations
  Clone ID: LIB3114-016-P1-K1-B7
gtccgnaataaaaaaaaaaaaaaaaaataaaaaatataaaaaaaaaaaaaaaaaaaaaaaaaaaaaaaagggaaaataaaaaaattagaaggggggggcggtttttttttatttccttccttcccttccttttccctcccttttttttctttgctttcacgtgcacttctttttttttgggcttggcttggtatctcccctgtcctgcccattccttcccctcgtctccatcttattttcccttggtttgcctttccctttttttttcggacccttttggttattttttttggttctgcccctgttctttccttttctttccttcttttctgtccttttttttttatctgatccccccccctccctggttttatttttccgcccccccgttggtttgtttttttttctttccggacccgtttctctttttcccttttctttttccctccctcttccttttcttttcctttcct

SEQ ID NO: 82968 - DNA, 86 bp, Zea mays
  Clone ID: LIB3114-016-P1-K1-B8
aaaaaaaaaaaaaatataaaaaaataaaataaaaaaaaaattaaaaattaaaaaattaatggggggggagataatatataataagt

SEQ ID NO: 82969 - DNA, 403 bp, Zea mays
  unsure at all n locations
  Clone ID: LIB3114-016-P1-K1-C1
cctgcaggtaccgtccggaatttcgtgtcgacacgcgtccggttagacctcaagttgtacctgtgcaaggactacctcaggtttgaaccatacttatggaatgcatgggggaggtttgtgttggagcaccggtctggcgagaaccgtgctccaatcatttcagatgatagccccaacaaagatatcaacaatgccttctataatatcgngatgatgaaaaagaaaagatgaaatggaactcaaattttagtggtcgcacaagtgtggagccagttgatgaccaagtttttcaattagtattttagtttgaatttagagtacacatatgtttgagttatttgacaatgcttgtttatgagagattgaatgatccctatctatattatattaattataatgttat

SEQ ID NO: 82970 - DNA, 452 bp, Zea mays
  Clone ID: LIB3114-016-P1-K1-C10
gcctgcagtaccggtcctgaattcccggcgggcgacgcgtccgagctgtaccatggggaagagaaagtcagctgctaagccacctcctaagaagcggatgggcaaggttgacactgtcttttcctgcccattctgcaaccacgggagtagtgttgagtgccgaattgacatgaagaatctgattggcgaagcatcttgtagaatctgtcaggaaaacttcatcacaactgttaatgcactcactgagcctattgatatatatagtgaatggattgatgagtgtgagcgtgtcaacactgttgaaggcgactatgatgcgtgagcttgccccatgcgatgaaactgttacctacaattcgaatgtaatgggctggtattctcgaatgccatagcccataagtagccatggcttggaataacgtaatggctgactgatatgcctagtggcacct

SEQ ID NO: 82971 - DNA, 274 bp, Zea mays
  Clone ID: LIB3114-016-P1-K1-D6
cctgcagtccgtccggattcccgggtcgaccacgcgtccgaaaaaaaaaaaatataaaaatataaaaataaataaaaaaaaaaaaaataaataataaaaaaaaagagggggggcctctttaaaggttccaagcctacttacttttgcttgccatcgtcttttcttttatattattcagcttatatatacttaattggccttctttttactatgttctgtctaacaaaaccctatctttctccacctttttttccttgttcctctttcctctttt

SEQ ID NO: 82972 - DNA, 418 bp, Zea mays
  Clone ID: LIB3114-016-P1-K1-E11
cgttcataagtgtgcagatcattacgtggtgggcccatatggcctaatctgacaccaatgcggatcgtcgtgagctctacaaacagaagctacaggccaataatagcttgatttttagagtacaaaaatctgttatttgcctgatagtttatctggagcagtttcattttacatatgactgtaatttgtgagaatgcacatcttacgatttttgttgaccagtattcataggtttttagttagcaatgtgttggttggcccgttgctagtccttgtaatacaagccccaccttgttttttttgcgcacgggcaaggaccttaaaactgaccaacatttttgtagtaacctttctatttttggtattacacctgcttctattaccacgaggttgttttttggaaacattcgggaaaatt

SEQ ID NO: 82973 - DNA, 357 bp, Zea mays
  Clone ID: LIB3114-016-P1-K1-E2
cacgcgtccgggagcatttaggtggtctcgatcgatggaagaattgtgtcctagccagccggcaaaggtgacctgctgatgatgatgatgagaggcgagtcctacgccctagtcctactactaccctctttgtgtgctgccatccatccgtccccgctagacgatcgaggagagaataacgcagagctctgtgctcccggcctctgtcttctgccgtcccggccgtttaatttatagtctctactgtgtgttcgtcccatgtgtttagcagcaacagcaggtgtattgggcgggtatgtaatggtattgcaactatattgggtgtaaaaccataataaatgtggaaaaaatgcaagg

SEQ ID NO: 82974 - DNA, 110 bp, Zea mays
  Clone ID: LIB3114-016-P1-K1-F1
ccaatcttactttcttctttcatacagacattatagctcttaatatattattaactaaatccaatgcagggggggacattttacaactgtatgaccagaaatacccatta

SEQ ID NO: 82975 - DNA, 432 bp, Zea mays
  Clone ID: LIB3114-016-P1-K1-F11
cgctggtacgcctgcatgtaccgttccggaatttccgggcggcccacgcgtccgcgtcaatttccgtgccgacgaatcaaccgcggaatgtaactgttgtcgttgaaaaccgaatgggagttgatgacaagggaaaattggtgtgcaatgttgtagtaggggttacgagcggcggtaaaaagtgacggcttatcacaacccgtatagctttgtccaaactatctaaaaagggtttaagaatacataccttgtatcatactgctgtttggcgatcggctgctcttcggaggaatccccctccctggagagcgtagtggcaaggcatcgctgctttcgccactgcgatcgtgctagaacgagccaaaagaataaacgaagtggcgggtgtgcatactcagagtatatttgtagcttgttaccccttgatttttt

SEQ ID NO: 82976 - DNA, 130 bp, Zea mays
  Clone ID: LIB3114-016-P1-K1-G5
gttttgtttagctgggacgcctgcagtaccattctcgaattccctggtcgagcacgcgtccgtaaaaaaaaaaaatataaaaaataaaaaaaaaaaaaagaaaaaataaaaataaaaataaaattagggg

SEQ ID NO: 82977 - DNA, 251 bp, Zea mays
  Clone ID: LIB3114-016-P1-K1-G9
cctgcagtaccgttcctttaattcccgtgcggccgcgcgcgttcgtgaagaaacccttcgttgggtcatcccatgccaagggcattgtcctggaaaatattggggggggggccaagcatcccaactgcgctattcgtttgtgtgctcgtgttcagcttgttaagaatggcaagagaattgttgcctttgtgccaattgacggatggttgatctacattgaggaaattgatgaggtcttgattggtggattt

SEQ ID NO: 82978 - DNA, 428 bp, Zea mays
  Clone ID: LIB3114-041-P1-K1-A1
gactcgtctcttgggctcaaggagctggagtggttcgaggacatcgacctgttccacggccattcgccagctaaaactgccatggcggagttcttcgcctcgccgcagccagtgagtaacgccgggttctacaaggcgaacggggcgcgcctgttcaagaagtcacggatggaggtgcctgacgacgacgacgaggactacttcatcgttcctgatcttggctgagaatgagatgagagatctctgcatgattctccagtcatgtgatgtgtgtatgtatgcaaaatatgtatgtatgccatcatggggtgcactgacgcttacgttggacatatgtaattatccagtcatgtgatgtgtatgtacgcaaaatatgtatgtatgccatcatgggatgcactgacacttacgttggacacatatgtaat

SEQ ID NO: 82979 - DNA, 63 bp, Zea mays
  Clone ID: LIB3114-041-P1-K1-A4
ctaaaaaaaaaaaatttatataaaaaaaaaaaataaaataaaaaaaacaaaattttctttaag

SEQ ID NO: 82980 - DNA, 381 bp, Zea mays
  unsure at all n locations
  Clone ID: LIB3114-041-P1-K1-A6
gctgtacgcctgcagtaccgtgccgaattcccgggggaggacgcgtgcgggcaatgatccttccctgcagacacgcaggcctacatggaccagcttaactatgacatgggggacccttacgaggacgggcggtcttgattgatatnanatgctccngtcctatgccccccaaataatggcgatgcatgcatatagtttcctggngtatgcggaactatatatgtgttgaaactgcaccaacgattagctggctgattgtgatggttaccttaagaactccagtgtattggattggtgtgtgctgggctgtgttgtcagaagcttgcaactttgtatatgtacatgtatgggattctggtaggttcttggagctgcgcgcna

SEQ ID NO: 82981 - DNA, 204 bp, Zea mays
  Clone ID: LIB3114-041-P1-K1-A8
ccttccaaaataaaatttatattattcaaacatacataaaacaaacaagattaaagaatttttaggaggggggggctcctaaaccccactctctctcccccgccttacaacttccttacttttttttaccctaaccctacttaacttaatcccctttcattataaaacactttcaccagaaaaaaccttatcttatacaaacta

SEQ ID NO: 82982 - DNA, 228 bp, Zea mays
  unsure at all n locations
  Clone ID: LIB3114-041-P1-K1-B11
acctgtccttaattcccgggtcgacgccactcgtcctaaataaaaaaaaaaaaaaaaacaaacaataataaaaaaaacaaacttactttcaagaatcaaagtttcttaaaaaaaaaggatatanttcctccctatcttccattttcttcccctttttttacaactcctttacttcaaaaacctccccttttcccaccttaattaccttacattaacatctcccctttc

SEQ ID NO: 82983 - DNA, 470 bp, Zea mays
  Clone ID: LIB3114-041-P1-K1-B12
aattcccgggtcgacccactcctctctaataaaaatttttttatttttttaatttttttttaaatttttttttttttttaagatttagattttttttaaaaattgaaaaaaacccaaaaaaaaaatttctttttcattatacatacaattcttttcttttatatttatattaaaaaaaaagggcccccccttttttaaattcccaattttcctcccccttctttccccctttttttttttttttttgttccccctaattcattttccctccccctttttttcccccttttttctttaaaacccccttctttcccccactttattccctttcaaccccttcccctttttccccttttttttttttccaaaaaccccccccccattcccctttcccaccttttccccccctttattttaaaattacccccccctttttccccccctttaacccctctttttttttttttccc

SEQ ID NO: 82984 - DNA, 463 bp, Zea mays
  unsure at all n locations
  Clone ID: LIB3114-041-P1-K1-B2
acgcctgcagtaccggtccctaattcccggggcgacccacgcagatcctaaaaaaaaaaaaaaaaaaaaaaaaaaaaaaaaaaaaaaaaacaaaacataatctctccctaagataaaagagtttaataaaaaaaaggggncanacnatntacttcaccccaaacaaagggccgtcctttttaaaaaaaccaaccttacatacccttacatccaacaaaatattttttttatatttccccctaaattaaattcactccccttctttttacaacattttaacaaaaaaaaccctacctttccccaacttaaaccccttaaacaaaatcccctttttcccaacttatttaaaaaaaaaaaaccccccaccaatcccccttccaaaaaatttcccaacctaaaaaaaaaattaaaccccccctttaaccccccattaatccccccattttttattattacccccaaa

SEQ ID NO: 82985 - DNA, 149 bp, Zea mays
  unsure at all n locations
  Clone ID: LIB3114-041-P1-K1-B4
tgtacgcctgcagtaccggtcctgaattcccttggggaggcacgcgtgcggactatttctatatcgcgagcgggcgctctataagatccaagcttacntactctgcgggcgacgtgatatctcggctataggggcacctaaattcaatt

SEQ ID NO: 82986 - DNA, 137 bp, Zea mays
  Clone ID: LIB3114-041-P1-K1-B5
tgtacgcctgcagtaccgtgccgattccctgggagcgcacgcgtcgactgtgtctaatccgagggggcctctaaggagtccaacgttactacctcgggcgacggataggtggggtataggggcacctaaattcaatt

SEQ ID NO: 82987 - DNA, 464 bp, Zea mays
  unsure at all n locations
  Clone ID: LIB3114-041-P1-K1-B8
gcctgcaggtaccggtccccaatgccggggggggcgccgcgtcctaantgactctagtgtgccaaagcgcacctgtaaacggggcataggaatcacggggaaacggggatggatctgagaggggattcanacnatnacttngcccctctctagaagaatatgaaccacctggacctctactaatatgaataaagggagggatagaggggaagggaggaaaattgggggctggaagggctggcatgggaactttacgactggtttacaactgaatttcangtggcttggctggtacgaagcaaccggtggagggggttcantggctaatanccacaataaggttcantgggcttttccgccacatggttaatgcgtgggtctgaaagaaatccttctgcgccttantaggggggatctatagcactatctttggagataaatgagtgattggacacatttggatc

SEQ ID NO: 82988 - DNA, 282 bp, Zea mays
  Clone ID: LIB3114-041-P1-K1-B9
tttactccttcattacccttccttaattcccgaatccacccactcatccttactagttctagattgtttccctcaaaaaaaaaaaaaaaaaaaaaactttcaagaaaaagatttttttaaaaaaaaaggagccctccataaaatccactcttccctactctacaacaccactactaacctattctctatcttcacctaacttaattttctttcactacattttcatttctccaccttcctcaatccctaaaacccccccacctatccccctttccaacaatt

SEQ ID NO: 82989 - DNA, 60 bp, Zea mays
  Clone ID: LIB3114-041-P1-K1-C2
ttaaaaaaaaaaaactaaaaaaaatacaaaattaaaaaaatactaaattatatttttttt

SEQ ID NO: 82990 - DNA, 335 bp, Zea mays
  unsure at all n locations
  Clone ID: LIB3114-041-P1-K1-C6
tgtacgcctgcggtaccggtccgaattccctggggaggcacgcgtgcgccctactacatacttcttgcgagacttgaagtgcgcattctccaataccttcaatctgtggtgtgggtcanttggaggagacgctnttggtcttacatgggagaacccaaataatctttgcatataggaagctgatgaagctgctccctatccgacatctatccttaacgagggtggacatggttgtaaacggttattgaagggtgtgtgccttgtcaaggcaccaaagtttcagtgaactgacagggcgtntgcaactgaatatctgaccaacaaacctattcaca

SEQ ID NO: 82991 - DNA, 306 bp, Zea mays
  unsure at all n locations
  Clone ID: LIB3114-041-P1-K1-C8
cgctttacgcctgcaggtacctttcctnaattgccggggggagcacgcgtgctatcacgctcaccacgtgccagctcccgccccactacaaggtgttctatcttcgggactgcggtcacatggagcttggtggcattggcccacaccttgagggagggcatcgcccccagtgtaccgtgccaccgaacgggggggttgggtcggtccccacactanacgtcgaggcggtcggatctgatgggagcggtcttgtgaaggctcggaagagggaccctgagctggattactcccttggtgggtggacct

SEQ ID NO: 82992 - DNA, 414 bp, Zea mays
  unsure at all n locations
  Clone ID: LIB3114-041-P1-K1-D10
tacccgtcctcaattcccaagtcgacccactcctcccaaaaaaaaaaaaaaaaaaaaaaaaaaaaaaaaaaaaataataaaaaccaatttaagaaaaagatttttttaaagaaaaaagccccncccttcccctccncctatctcctttctttcttccccttacattaacacctacaaccctttctataaccctcaccaaaacccaattaaataaatcttccttctccccttcttttaactccaaaatcattttccttttctccttcccactctctatttttttatattcccccccctcaaataattttttctcctaccctttacttcccccctctaatttcttcttaaacccctcttttctcccccacaataaactcttcttattaaacccacttcctttttttcccccccctc

SEQ ID NO: 82993 - DNA, 237 bp, Zea mays
  Clone ID: LIB3114-041-P1-K1-D12
caccaggtaccggtccccaattggaggggcgacgccacgcgtccgggtgttatcgtatcggaggacgtctgaagatgtcacaattactcacgcccctggagtggggctttaggaagtgttcgttgtaccctaaacctaatatactcggctgattcttcaattgtattcctaaaagatactactcccaaaaccaaaataaaaaaactttaaaaaaaaacccctttttacaaaattgaa

SEQ ID NO: 82994 - DNA, 74 bp, Zea mays
  Clone ID: LIB3114-041-P1-K1-D2
ttttaaaggatccaagcttacttacccgtgcatgcaacgtaatagcttttttataggggcacctaaattaaatt

SEQ ID NO: 82995 - DNA, 73 bp, Zea mays
  unsure at all n locations
  Clone ID: LIB3114-041-P1-K1-D4
tctatangatccaaggttacttactcgtgcaggcgacgtgatanctgtggtatagggtgacctaaattcaatt

SEQ ID NO: 82996 - DNA, 236 bp, Zea mays
  unsure at all n locations
  Clone ID: LIB3114-041-P1-K1-D5
taaaaaaaaaaaaaaaaaaaaacaaaaacaaaaaaaaaaaaaaaaaaaaaaaacttccctcaaggaaaagatttattcaaaaaaaaaggggncacccncccccccccctcttttatacaatttcctacacttcttcttcctacaacctttttttttttttttttaatctaaaaaaaatacattcccccccctttaacaacaccccttaccaaaaaaaccctcccccctcccccctt

SEQ ID NO: 82997 - DNA, 181 bp, Zea mays
  Clone ID: LIB3114-041-P1-K1-D6
acccatccttaattccctggtcgacgccactcgtcctaaaaaaaaaaaaaaaaaaaaaaaaaaaaaaaaaaaaaaaaaaaaaaaaaaaaacatattaaagaaaaaaattttaaaaaagaaaaaaggccctctaaaaacctcctctatttacatccccttaccataaattctactacctttt

SEQ ID NO: 82998 - DNA, 140 bp, Zea mays
  unsure at all n locations
  Clone ID: LIB3114-041-P1-K1-D7
cgtcctggaaaaaaaaaaaaactaaaaaaataaaataaacctgggggccgggttcatcagggggagggggtcttggggggggggggggngcttattcctttttctataacaaacctctacattcttttaagcggccccgt

SEQ ID NO: 82999 - DNA, 298 bp, Zea mays
  unsure at all n locations
  Clone ID: LIB3114-041-P1-K1-D8
attaccagtcctnaattcccgggtccacccacccgtcctaaaaaaaaaaaaaaaaaaaaaaaaaaaaaaaaaaaaaaaaaaaacaatctttaagaaaaaaattttttaaaaaaaaaggggcnnnncnccnnctttccctttccccttctctaaccttccaatcccttacctcttccattcttacacttaacttcaattccctaacccttaaatttccatccacttaactacaaataccaaactcataacaacctcaactctactaactcaaatcccactcccccatccccctttccct

SEQ ID NO: 83000 - DNA, 451 bp, Zea mays
  Clone ID: LIB3114-041-P1-K1-D9
cgcctgcaggtaccgggcctaatggcggggggaggacgcgtgcgctccccccccttttttttttttttttttttttttttgggttaaacaaattcacgtgaggggtgtcatggggggggggggcggtatatccaaccaataggggccagtacacaaactatggacaggtggtggagagagagaacaggatcaactcttggtcttcaaagattgggggggcagggatacagaggggggggcaaaacttgtgttggcaataaaccaggagagaacccacttcagattggacaggatggactttaaaggcttgggccaggtttcattcttattggaactaagggcgatcgggggggtccctactttggcaccatcaatcttggagggaagcttcagggatttttcagggggaacattggtctggttatccaaacttatgggaaactcagcaaac

SEQ ID NO: 83001 - DNA, 410 bp, Zea mays
  unsure at all n locations
  Clone ID: LIB3114-041-P1-K1-E10
tcctgcaggtaccggtccccaatggccggagcgagccacgcgtgctcgaggacctgacctaacagtaacaggctgagcggacgacggtggccatctccgacccgggtgcattccaagctcggggcatatatttntatatcatacanataactgggacatgtaaacattttttgggggtttgggttttcaggtttgtcacaaacaggtcactggctcaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaaaaagggggggccgttttaaagggtccaaggttacgtccccgtccttccaacttaatagtttttttatagggggacctaaatcaaattta

SEQ ID NO: 83002 - DNA, 503 bp, Zea mays
  Clone ID: LIB3114-041-P1-K1-E12
gtacccgtccttaattcccgggtcgacccactcctccctaaaaaaaaaaaaaaaaaaaaaaaaaaaaaataaaaaaaaaaaaattaatttaaaaaaaaaaattttttaaagaaaaaaaaaaaacaattcccctaaatttccttcaccacttacccaaaaaaatcacattctttcaacactaatcaaaaaccctaatttattccaaattggtcccccctttttaaaattcccaattttttccccttttcttatcacaattattctttttttttatttcccccaaaataaattccccccccccttttttccccccccccctctctaaaaaccccttttttcccccctttttattcctttttaaaccctctccttttttcccccttttcttaatacacaaaacccccccccccaatctccttttccaaaaattccccccccccttaaacccaatttaccccccccttttcccccccttttaacccctcctttttttttttcccccc

SEQ ID NO: 83003 - DNA, 74 bp, Zea mays
  unsure at all n locations
  Clone ID: LIB3114-041-P1-K1-E5
tctataggatccaagcttacntactcgtgcatgcgacgtgatanctctgtggataggggcacctaaattcaatt

SEQ ID NO: 83004 - DNA, 401 bp, Zea mays
  Clone ID: LIB3114-041-P1-K1-E6
attctatatctccatccctccctctatataattcaaacttacctaccccttcaaagcgaaggggtttttaaaaataagaagacctaaattcaattcactttccctccttttacaaccttcttacttataaaaccctttctcttcccaacttaatcctccttcaacacattccccattttccaacttcgcctaatatccaaaaatccccaaccctatctccctttccaacacttatccactcttaatacccaattttaccccccctttacctcctcattaaacacttccccttttcttttactcacatacattacctattcactttccacactcctaaaccccccctccttttccctttctttccctttctttttttccccacctttctccctctttttccc

SEQ ID NO: 83005 - DNA, 164 bp, Zea mays
  Clone ID: LIB3114-041-P1-K1-E9
cactcgtcctaaaaaaaaaaaaaaaaaaaaaaaaaaaaaaaaaataaagggaaagaaaattaaggggagggggtttaaggggggagggggcgtctaaaattccaatcttactaccccttccatccaacctcatatctcttctatactggcacctaaattcaatt

SEQ ID NO: 83006 - DNA, 432 bp, Zea mays
  unsure at all n locations
  Clone ID: LIB3114-041-P1-K1-F1
ccggtccggaattcccggggcgagccacgcgtccggactagttctaaatcacgagcgcccatcctatcattatatcatcacccaactttacatgagggcggccgtactggagcggagctgggaactgaactgcatagcgcactaacctagcagcggagcatggtctcagcccacaaactttactacaatacatccactccactacacaacacaccctgtcctgcgggacggtacagcacaacaaaaaaacactgctctattaaatagtggggagggaactaaactgtctatcatatcagttggagaatgatactctactcaaatcaaacctctgatcccaacctttggtacgccacgccattacataatctactattctatgcattgcattttttcnaaaaaaaaaaggccaaacccaaaaaaaataactta

SEQ ID NO: 83007 - DNA, 158 bp, Zea mays
  unsure at all n locations
  Clone ID: LIB3114-041-P1-K1-F3
taaaaaaaaaaaaatctaaaacataaaaaaacaaatataaaaaaaacaaaaccttcctttaaggaaagagcttttccacaagagagatctantctcacctaaccttccattccttcccacacctttttctattttatagacttaaattaaattcaatt

SEQ ID NO: 83008 - DNA, 73 bp, Zea mays
  unsure at all n locations
  Clone ID: LIB3114-041-P1-K1-F4
tctatatgatccaaggttacntactcgtgcgggcgacgtgatanctgtggtatagggtgacctaaattcaatt

SEQ ID NO: 83009 - DNA, 497 bp, Zea mays
  unsure at all n locations
  Clone ID: LIB3114-041-P1-K1-F5
aattccctgtccacccactcctcctaaaaaaaaaatattaaaaaaacaaacaaaaaaaaaaaatcccaactttctctcctcctttaagaaaaaatctttcttcaaagagagggcggnccccccccctccttccaccccctcccttccttcctcctccctttcccgacattcctttttttttcccccccctaccatcctttacccctttttaaatttcccccaacttcactttccctcccctccttttacccccctttttttcatacaaccccttcccctccccacctaatccccctttaaccacccccccttttccccccttcctttttaaaaaaaccccccccccctttcccctttcccccctccttccctaccctttattccctatgggcccccccctttgattcccccccctaaacccccccccttctttccctttcccccccaaccccccccttttcatttttcctcccccccctttccccccccctcttttt

SEQ ID NO: 83010 - DNA, 74 bp, Zea mays
  unsure at all n locations
  Clone ID: LIB3114-041-P1-K1-F8
tctataagagtccaaggttacntacgcggtgcgtgcgacntcataggttggtatantntcacctaaattcaatt

SEQ ID NO: 83011 - DNA, 77 bp, Zea mays
  unsure at all n locations
  Clone ID: LIB3114-041-P1-K1-F9
gcggtctagaggatccaaggttacttactggggcggggacttcataggtgggggtgtantntcacctaaattcaatt

SEQ ID NO: 83012 - DNA, 387 bp, Zea mays
  unsure at all n locations
  Clone ID: LIB3114-041-P1-K1-G11
ccttccaaatttcttagctaccggcatggaacttctaaaggacctaacttaagggaggactgaaatgtctttacaaaaaaacttaccttccaacatcttttggatgtgtgaagacaactgacaaaaactgggtggacttcaaaggaacctggactggatactttancctggcatccttgatcctggcatggggggggggcacatcattgagggttggacatgggattatgacaactggatctggcataagctggataattggaattaatacatattatcttttttttttggcgattggaacatctcgtgaggcatggttgagcttaaaaaaatggtgggggtaggcatttttatggacaggcctaccagcagtgatggtcacattta

SEQ ID NO: 83013 - DNA, 462 bp, Zea mays
  Clone ID: LIB3114-041-P1-K1-G12
ctccaagtaccggtcctcaattccacggtcgccccactcatcctaaaaaaaaaaaaacaaaaaaaaaaaaatacctaaaaaacaaccccccttctccaaagaacaaatctttcccaaagaaaaaaaaaaaaaaatctcctcctcccttcccctcccacctccttcccccccttctcctcccccccttctccctcccttccttcctccccccccaactaccttcccccctacctctcctccccctccctaattcccccctctctttcctccctcttctcctttttaaccctttcccaacccccccctatcccccttctccccccccctttacccccacttccccatttcttcccctcttttactcccatctttcttcccctctttctctccatccctctcccccctttttcttctccctctttcacccccccctctccccccctccccccctttcatttcccc

SEQ ID NO: 83014 - DNA, 205 bp, Zea mays
  Clone ID: LIB3114-041-P1-K1-G4
tttcctcaccctttattcctaatttgactctccctttacctgctcattaacctcttcccttttcttacttacccacaacagtactctttacactttccaattccctaaccccctctcctttccctctcttcccttcctttttttccactttcaccttctttccccatcaaactctaaatcttaaacttcctttacttttctactt

SEQ ID NO: 83015 - DNA, 466 bp, Zea mays
  Clone ID: LIB3114-041-P1-K1-G5
ctttactccttcaggtaccggtccctaattccctggtcgacccactcatcctaaaaaaaaaaaaaaaaaaaaaaaaaaaaaaaaaaaaaaaaaaaaaaaaaaaaaatcataaaagaaacatctctctttaagaaagagccaagcttactttccccttcataccactccatatcttttttataatctcacctaaattcaatccactcacccctctttttacaacataatcactcttaaaaccctttctttacccaacttaattcaccttcaccacatccacctttctccaattccccaaataaataatattcccccacctaccccttttcccaacatttttccatcctaaaaacccaatcctaccccccctttataaactcattaaaccctaattttctaattaatactcccataaaaacccctaccacttccatccccctaacaccctctcctttccctttcttcc

SEQ ID NO: 83016 - DNA, 478 bp, Zea mays
  unsure at all n locations
  Clone ID: LIB3114-041-P1-K1-G6
tgtacgcctgaggtaccggtcctgaattcctcgggggagcgcacgcgtgcgtgctanttccaaggttccttccaaatttcttgaactaccgtacatggaacttctatgcgaccctaacttgggtggagcttaaaggtgtgtacagagaacttgaccttccaacatcttttgaatggctgaagacaactgacaaaaactgggtgaacttcaaagcaacctggactggatactttancctggcatccttgatcctggcatggggggggggcacatcattganggttggacatgggattatgacaactggatctggcataagctggataattgtgattaatacatattatcttttttttttggcgattgtgacatctcgtgaggcatgtttgacttcaaaaaaatggtgggggtaggcatttttatgtacaggcctaccagcangcatggtcacatttaccttggtgcgacctttcgtata

SEQ ID NO: 83017 - DNA, 74 bp, Zea mays
  unsure at all n locations
  Clone ID: LIB3114-041-P1-K1-G7
tctataagatccaatcttacttacgcggtgcagggtacntcataggtgtgctatagtntcacctaaattcaatt

SEQ ID NO: 83018 - DNA, 357 bp, Zea mays
  unsure at all n locations
  Clone ID: LIB3114-041-P1-K1-G8
gccggcaggtgccgggcctnaattgccggggggagcgcacgcgatgcgcgattcctttctcccaaacaatctgtctgagtcaatgccaaacgtactctctgtttcgatgtagggggggcagatgctttcctataaaaaaaaaaaaaaaaaaaaaaaaaaaaaaaaaaagaaaaaaaaaaaaaaaccggggggggggagaaacggaaaaaaacaaaaagcggggggcggggaaagggagcccagggtaaagaggacgggggggggccgggcaatgggccaaaggggcaaccaactgaggagcgaaagggacggtcccacgagccgaaccaaaaaaaccccaggggggcgggggggggg

SEQ ID NO: 83019 - DNA, 387 bp, Zea mays
  unsure at all n locations
  Clone ID: LIB3114-041-P1-K1-G9
cgcctgcaggtaccggtccttaatggggagtggaggacgcgtgctagcatgcgactgggtttgtgcaatgtgcgctgaancgtgatgaggtttntgagggtatgaggtatccgggggacggggaaacactattgatgtatatctaccaccacctggtgatttggtggaccacanactggcgggggtaggtggaaatgacagggaatggttatggttctaggggcaatggngatatttgggtttggacggcgnaaaaaaaaaaaaaaaaagataaaaaataaaaataaaaaaaaattaaaagggagatattttttaaattgtgtaattttagaatttattatattgaaaggggggggggggtttgataaggtatttttatttttgttg

SEQ ID NO: 83020 - DNA, 102 bp, Zea mays
  unsure at all n locations
  Clone ID: LIB3114-041-P1-K1-H3
aaaaaaaaaaaaaaaanngggggctccccctcaaaaaaacccaaattttcttcccccctcttccacacttaaatttttttttataggccccccaaattaaat

SEQ ID NO: 83021 - DNA, 280 bp, Zea mays
  Clone ID: LIB3114-041-P1-K1-H7
ctttaaataatccaatctatcatacccttccatacaaccttaacacactttttaattttaacacaatacaaatttactatacctattattccaacactcttactctaaaaaccccattcctcaccaaactaaatcccctttcaaaataacccccttttcccactctcccttttttccaaaaaacccctaaccaaaaagccctttccaaaattcttttttcaaaaaaaaaaaaaaaacacccccccttaaaattccctttaatcacagcgtcctttttata

SEQ ID NO: 83022 - DNA, 342 bp, Zea mays
  unsure at all n locations
  Clone ID: LIB3114-041-P1-K1-H8
tacgcctgcaggtaccgntccttaattggaggggggaggacgcgtgcgcggagtgcgagtgatccggtaaaaacccaccccggtgcggtcgcgcctctggggagaggtggactttgggggggggcttccttntactcttatcanaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggggcgttttaaaggatcaaaggttacgtacgggggaatggaacgtaaaagtttttttataggggaaccaaaattaaattaatggg

SEQ ID NO: 83023 - DNA, 296 bp, Zea mays
  Clone ID: LIB3114-043-P1-K1-A2
tcgcctgcggtaccggtccggattcccgggtcgcgcacgcgtccgaaattaaccatcttgaactggcattattccactttaaaaaaaaaaaaaaaaaaaaaaggggaaagggaaaaaaaaaaaaagggggggggaatacataaaaaaaaaggcaagcttttttagggggccctagccatacatacgctgtcctagggcgttcctttttggtgtttgggttccctttgtcgttccccaggttaattagtttacagggggggcccccttaaatcatttggcttccccccgtttaaccc

SEQ ID NO: 83024 - DNA, 99 bp, Zea mays
  Clone ID: LIB3114-043-P1-K1-A3
cctgcagttccgtctccgattctcctttcgacccaggcggccgaaattaaccatcttgaactggcattattccactttaaaaaaaaaaaaatcaaatta

SEQ ID NO: 83025 - DNA, 464 bp, Zea mays
  unsure at all n locations
  Clone ID: LIB3114-043-P1-K1-A4
taaaaaaaaatttttttacaaataattatcactaaaaaaattaacaaaatattatttttttttaaactaaagagtcacaccccaacaggagatccacctcccaccctcctnncctcccccctttcttttcctttcccctttttttaaaacctcctttctcttcccccccctctttctttttagataccctcctttttcccctcttcccctttctttatatttaccttctcttacccccctccccctttttcctttccccccttttcatttcccctttcccctcctctttcccccatttttttccacactcttccttctcttccctcctctccttccccccccccctattgccttcccttttctcccccccccccccccccttcccttttccctcccttttgtcccccccctcttcctttccttttccctctttttcccctcaaacttcccttttccctcccccc

SEQ ID NO: 83026 - DNA, 441 bp, Zea mays
  Clone ID: LIB3114-043-P1-K1-A6
gagggatcccagccaccgccgctagaagaagagctcggcgattcccaggtcccgcgagaagatgcgcgaagcagatctatgagattaaggacttcctcctcaccgcgaggaggaaggatgcccgctcagtgaagatcaagaggagcaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgggttgaactacccaagcttctttatcagtagcagagcatgctactcatgtacttttggaacctaagctattagacctgtcagtgttggatgtgtggatcttgcatttttgtggagaaataccaatttacctcgttcaaggatgcacctt

SEQ ID NO: 83027 - DNA, 471 bp, Zea mays
  Clone ID: LIB3114-043-P1-K1-A7
cctgcaggtaccggttcggaattgccgggtcgacccactcgttcgtattttaactactttatataaaaaatatttttaaaataaaaatattataaaggattaggtaatattttaataaaaaaacaaaaattacttattatttttttataaaaaaattataataaaaaggggcgccttttttaaaaaatcaaaattttcataccctttctttcaactttataatttttttttattttcccttaatttaatttaattgcccgtttttttaaaactttttaattggaaaaaccttgtctttcccaaatttattttctttgaaaaaaatccctttttttccatttggttttataccaaaaaggcccttactttttttcttttcaaaaaatttcccaaccttaattgcaaatagaacccccctttttccggccctttaaaccccgcgtttgtttgtttttctcccaactttacctt

SEQ ID NO: 83028 - DNA, 247 bp, Zea mays
  Clone ID: LIB3114-043-P1-K1-B1
tgtttgatgtggagtaatgcagtaccatcacctcagctagtattaagtgtagataggtgtggatgattttggtgaatggtgttatggacggaaatgctgcaggctgagcgacctagtaacctatgccatgtagtggcatctaaattagcctgggattgtgtatgcgtaaaaagaacgcctaagacttaaccatgttattatgtcagcttggtacatggtgataaaaagaatctgaccatttcatgtc

SEQ ID NO: 83029 - DNA, 439 bp, Zea mays
  Clone ID: LIB3114-043-P1-K1-B3
gcagggaggatggataccaatgacagtctaagattagcaagtctgtggcattcgatgcatgctatctcccagcaactctcccctacccctggctgtactggcattgatctcttacaagctcataactttgatctccattgctttcaatccctcacagggacaaaatttttcgttgtatgcgaaactggagctccaaacatggaaatgctgctgaaagtgatttatgagctgtacacggacttcgttttgaagaatccgttctatgagatggagatgccgatccggtgtgagctgtttgatcacaacctggctcagatgatccagaaggaccgtgttgcgcttctgggtcggtgaatcttgaaaactcatggtctcagcccttgaaaaccctacttttccgttttcgacgcttggacttgctctgctggaaccctaaatt

SEQ ID NO: 83030 - DNA, 432 bp, Zea mays
  Clone ID: LIB3114-043-P1-K1-B4
aaaaaaaaaaaaaaaaaccaaaaacaaaataaaaaaaacaaaaactgaaacattcaatacggagaggggtcccaacaactataccctacccctaactgtactgacatatgatctcttacaaactcataaacaaaggggggcgcccctctttttttttttttttttacaaaaaaaatcccattttttttattttttcgctccacacattttttttttgctcaaagggatggatgagcttttcacccactcccttccgaataccccccaataaaaaaaagagaaacccttccggggtgggctttttaatcaccccctgtttcagaccccccaaactttccttttttttcattatccccgggaagaggttgaaaactcattttctcagcccttcaaaaccctttttttttttgttcgacgcttggactcgccctg

SEQ ID NO: 83031 - DNA, 376 bp, Zea mays
  Clone ID: LIB3114-043-P1-K1-B5
aaaaaaaaaaaaaaaaaaaaaaaaaaaaaaaaaaaaaaaaaaaaaaaaaaaattaaaaaaaaaaaaggggaaaaaaaaaaaaaaaaaaaaaaaaaaaaaaataaaataaaatttaaataataaaaaggggccccctttttatagattccaacctttcttcctcttccatccaaatctatatttttttttttgggtccccaaatttaaatttattggccgtctttttaaacctctattatttggaaaaaccttgtcttccccaatttaattaccttgaaaaaaatccccttttccccggttggctaaatacccaaaaggccccccccattcccctttccaaacatttccccaccctaaattgcaaaaggaacccccc

SEQ ID NO: 83032 - DNA, 176 bp, Zea mays
  Clone ID: LIB3114-043-P1-K1-C12
aaaaaaaaaaaaaaaaaaaaaaaaaaaaaaaaaaaaaaaaaaaaaaaaaaaaaaaaaaaagagaaattaaaaaaaaaaaaaaaaaaaaaaacaggggcgccccttcttaaaatccaagcttacattcccttgcttgcgacttcatacctcttttttagtgccccctaaattcaatt

SEQ ID NO: 83033 - DNA, 106 bp, Zea mays
  Clone ID: LIB3114-043-P1-K1-C7
aaaaaaaaaaaaaaaaaaaaaaaaaaaaaaaaaaaaaaaaaaaaaaaaaaaaaaaaaaaagaaaaaaaaaaaaaaaaaaaaaaaaaaaaaaaaaaaaaaaaaaaaa

SEQ ID NO: 83034 - DNA, 204 bp, Zea mays
  Clone ID: LIB3114-043-P1-K1-D4
ccagtgtgagcgagagcatgctgagcgggaaatgaagattttggaagcccagaaattgtcggtcgatgcttcagctcagaacgaaagctctgattcctttggcagtgctgacaagtgaaacacttctcctgttttccctcacttgtgacctggcttcacctctgttaattagagttgttgctcagatgccaatttgacaccttt

SEQ ID NO: 83035 - DNA, 164 bp, Zea mays
  Clone ID: LIB3114-043-P1-K1-D6
tactaattaatatatcacaagcaaacaatataaaaaaatacaaacttacatacatccttacatccaaagagctaacctataaaagagtctataccttcattccattcactttccttcattctacaaccctatgactggcaacaccctgactttacccaacttaa

SEQ ID NO: 83036 - DNA, 373 bp, Zea mays
  Clone ID: LIB3114-043-P1-K1-D7
tttttcacacaaaaggtggggtatggataagattatagatggatggtgacacaacacagcagggcacatggctagcctgctagcgtgcggcacccacacaacacaacacactgttcgccagaagcgccccaggaggccaggggaggacacgacgccgccatcagccatcatcatcatctcagactcagagcatgccatggcacgcaactgactgactgactcgaaacacacacagcgacgccgctatactttattaagctttataattagctagcttcctccggccggcctgcaaggtggagcacctagctcacttgccgcagttgcaggggtcgcactggcagttgccgccgcacttgcacccgccgttctc

SEQ ID NO: 83037 - DNA, 432 bp, Zea mays
  Clone ID: LIB3114-043-P1-K1-E11
gcagggaggatggataccaatgacagtctaagattagcaagtctgtggcatgcgatgcatgctatctcccagcaactctcccctacccctggctgtactggcattgatctcttacaagctcataactttgatctccattgctttcaatccctcacagggacaaaatttttcgttgtatgcgaaactggagctccaaacatggaaatgctgctgaaagtgatttatgagctgtacacggacttcgttttgaagaatccgttctatgagatggagatgccgatccggtgtgagctgtttgatcacaacctggctcagatgatccagaaggaccgtgttgcgcttctgggtcggtgaatcttgaaaactcatggtctcagcccttgaaaaccctacttttccgttttcgacgcttggacttgctctgctggaacc

SEQ ID NO: 83038 - DNA, 394 bp, Zea mays
  Clone ID: LIB3114-043-P1-K1-E12
cagaatttagtgaagctgacactggaaaacaagagacacccgtgtctgctgaggctatggtagaatcatcgagcgagcctcgcagccatgaggcaaaggaagctccaacccctgacctgtctggggatgatgaaaaagcgaagtcagcaagggctgctgttgttgcggaactttttggagatgcaacagaaggtggttcggatcagccattgccgtctcctagagaacaaggcaaggaagcagaggccgatggaggcttttagagtaaagttgcaaatattgtatcaagagatactagaatccgtgtaagtaagaactgctaatagtgcttttagttgtaactggtgtaagcttctactcagaatcaaaagcgacgtgctgagattacagcaac

SEQ ID NO: 83039 - DNA, 390 bp, Zea mays
  Clone ID: LIB3114-043-P1-K1-E4
cacggttaaagagcctggaatgtgctcgaagaggttggccacggaggctgcggagcggggcagcaaagacaatatcactgtcattgttgtctttcttcgccccgtctccacagctgagcgaatctactgagtcacctcccaaaacctattctcattaacttcaggtggccataccgcacgccttccgctgttaagtcgcaatttttgtattcgatccacatcggttctcaagaagaaaagaagctatactatacgtccattcttgtatttgtagatagaagaaacagcagcctctgcggcggctctttttttcaatcttttgaaacatttctcgtgtgtaaactatgcaagctgaatggatattgttggcatcgatttgagcgtcaaaaa

SEQ ID NO: 83040 - DNA, 208 bp, Zea mays
  Clone ID: LIB3114-043-P1-K1-E5
cccacgcgtccgaaaaaaaaaaaaaaaaaaaaaaaaaaaaaaaaaaaaaaaaaaaaaaaaaaaaggagggccaaattaaaagaagcatgccttactacgggcgccctcttttaaagagccaactttatttacacacccatgccccattttctcatcctttttaattcaacctaaattcaattaactgcccgtagtttccaaccttaat

SEQ ID NO: 83041 - DNA, 426 bp, Zea mays
  Clone ID: LIB3114-043-P1-K1-F1
taaaaaaaaaaaaaaaaaaaaaaaaaaaaaaaaaaaaaacaaaaatatttaaacaattcaaaaaaaaaaaaacatacaaaaaaaaaacctacccaacctttataattcccttcccacaacccattccacttttctttcttttacaacctatatttcttttcaaaactctttccttttcccaactttacctcttttaaaccccttacccctttttcctcttaccccctttttaaaaaaacttcctttcctaacccccttttttatcccctataaaacctccccttttcctttcccctcttcttcactatctatttacctacagaccccccccctaatccccttcccaaacccctacaatttctaactctccagccccccccctttacctcccccttcccttcccccccctttaccccctctccttcc

SEQ ID NO: 83042 - DNA, 62 bp, Zea mays
  Clone ID: LIB3114-043-P1-K1-F7
aaaaaaaaaaaaaaaaaaaaaaaaaaaaaaaaaaaaaaaaaaaaaaaaaaaaaaaaaaaggg

SEQ ID NO: 83043 - DNA, 435 bp, Zea mays
  Clone ID: LIB3114-043-P1-K1-F8
gctggacgcctgcggtaccggtccgaattccgggggggggacgcgtccgcgctcctgttggtccgctacgcacgccggatttttgcatcgagcacggagatctacggcaaaaacatggagctacgacgcgattcccaagtatgatggattccactattcatcaaccgaaattatggcgcgcttcaatcgtggctacgctgatggggaactgatccgttatggtgtgcttggatcgtggctgtgtggagatgtgtggaactcattggttataatggtgatgctgatggaactgattttgctcccgttggacggcctgattggttactttgccctgttgactgtttgagaacgtaccggccaggtttacttatacttactgctttttgacggtactgtacatacagttcgacaatttatttattggcagttcaattc

SEQ ID NO: 83044 - DNA, 72 bp, Zea mays
  Clone ID: LIB3114-043-P1-K1-G12
ttaaaagatccaagttaacgtacgcgagcatgcaacgttataacttttttataggggcaccaaaattaaatt

SEQ ID NO: 83045 - DNA, 108 bp, Zea mays
  Clone ID: LIB3114-043-P1-K1-G2
taataaatctagttcgtaagcagacaaaataaaaagataacaagcttacaaacttcttaagggcaagggcataaacaatgcgagggggtcacttttttttaaagttac

SEQ ID NO: 83046 - DNA, 385 bp, Zea mays
  Clone ID: LIB3114-043-P1-K1-G9
cttgagtatcatccaaagatgttgaaagaatttattgagggaactgagtcaagtggggtcatgtacccaagtgcagtatataattttaaaaagcagtttgcataccttgaggaacattatgccaagggatctacgggaactccacctgagaggcaacataactcattgccacggccttctgttgtctattcagacaaccaatcacaaagcacgggcaatataacagaggatctttccaagtgtataatcagagaaaatgcacagaagtcacagcaatataatgcttcagttgcaaataaatttccatcccatgttcctcaaggtgctgctgcaaagcctggtatagtacacaacatttgaaccgatgatggttgatctgaactca

SEQ ID NO: 83047 - DNA, 296 bp, Zea mays
  Clone ID: LIB3114-043-P1-K1-H12
ccaagtggacgatttcctctacagccttcttggtctgctgcgagatcaatatcagaagctcgaccacggcgtcttgagcaagattcccaaggggaacatgaaggctaagaagaacgagtagtttagcagatggtttctcgtgaatgagatcaatatcgttttgacttgtgtcgattattaatttattacctaaggcgtgtgtgccattctgaacctggctgctagttcatcgcccaccggggttttaaactactaagctgcaatgcacaagtaatgaagtgtgctagttcattgcc

SEQ ID NO: 83048 - DNA, 338 bp, Zea mays
  Clone ID: LIB3114-043-P1-K1-H6
aaaaaatgacaattaaacaaaaagaataaggattgctgtagaatccaaaccaacatacacgaccaaagccaccacaaaacaaagactatactttttacctaaattaaacttcaatggcccttgctttacaccacataatactggtaaagaccaccacttaacccaacttaattaacttacagaacatacccctttcacctgctggcctagtaacaaagagaaccgtgccgatcccctcttcaaccctacaacagcccttatcgaaactaaaacgcaacctgcagtggcgcattatatacaacgcatgcttgggttaccctccacacaacctgatcact

SEQ ID NO: 83049 - DNA, 384 bp, Zea mays
  Clone ID: LIB3114-044-P1-K1-A10
aaaaaaaaaaaaaaaaaaaaaaaaaaaaaaaaaaaaaaaaaaaaaaaaaaaaggaaaaagcgcgaactaaatataacaaaccccccaaaaaaacactctcttattaaaaaaaacggcggtcctttttacgggtcccaggtttccccccccttccatccaacttaacaccctttttttggggccccctaatttcatttccctgccccccgttatacaaccttcttcccggaaaacccttgttgttcccaaataaactccctttcaaccccatccccttttcccatgttcccttattacttaaaacccccccccctatcccctttcccacctttttccccccctttttgccaattggacccccccctttcccccttctttaacccc

SEQ ID NO: 83050 - DNA, 346 bp, Zea mays
  unsure at all n locations
  Clone ID: LIB3114-044-P1-K1-A2
cacgggcctttccggggggagccacgcgtccgcctcgccgcggcctccctcgccgccgccgccttcggctacctcttctgctagatccgcgctggatacgtggttcctgctccaaaatatgattcgtctggtctggcgcgcgtgagtccagctcgtgtgtcgtgtgtgtctctgtgtgaggtgtcggcgggcgtgtgtgtatgtatggagtcngccgcggcggcggcggcggaggaggtgtgcgcgtggtgggtggtacgtgcttcgacgcgccactgtttgtcgcggcgatcatgtactaccctgctgcgttttctggttatcaatgagatgatttatttgattc

SEQ ID NO: 83051 - DNA, 202 bp, Zea mays
  unsure at all n locations
  Clone ID: LIB3114-044-P1-K1-A3
ccgctccggaattcccggggggaggcacgcgtgcggaaatgttaaattatcagtattcttcttcttcctctgcttctcgtatttgtactttagcgaattcgggctttcgttcttgccaagaacacaacnnanaaaaaaaaaaaaaaaaaaaaaaaaaaaaaaaaaaaaaaaaaaaaaaaaaaaaggggcggcaggccaaaaa

SEQ ID NO: 83052 - DNA, 257 bp, Zea mays
  Clone ID: LIB3114-044-P1-K1-A7
gcgtccgagtaatgtgatcgcaagacaaacgatgttatttcaaaaaaaaaaaaaaagggggaaaaagagaaaaaaaaaaaaaaaaaaaaaaaaaaaaaagaaaaaaacacgctggggggccgcttcttaaaaaagtcccaagggggcgggccgggttaaaggaaccaatattcttttttcgggcatccacaacttaatttctggtgggggggcatttaaaaccaatgtagtggccaaagttttacatcctccaaact

SEQ ID NO: 83053 - DNA, 328 bp, Zea mays
  unsure at all n locations
  Clone ID: LIB3114-044-P1-K1-A9
ntaaaaaaaaaaaaaaaaaaaaaaaaaaaaaaaaaaaaaaaaaaacttttcggaaattgccgcgaataaaaaaaacgcccccaccacaaccaaacaaccccttttaaaataaccccattttaatttccctttccctccccccctttttataactttccttttctttttccccacccccttttcacctcctctccttttttcaatcttacccccnngcccaatctttccccttccttattaaaaccccttccctgaaaaacccctttttttcccaaattaaaacccttaaagacctttccccctttccctttctccctttattccaaaa

SEQ ID NO: 83054 - DNA, 362 bp, Zea mays
  Clone ID: LIB3114-044-P1-K1-B8
ccacttcccggcaccggcctccgcctccccgggacccgcggcggagatcaccttcgcgacggagggcaagggcgacgccaggatcgcggtggagaacgggaacgtcgccgggatgatccagacctggtacctcggcggcgactccgcggtgtcccccagcaccgtccgcagcctggccaaccgtttcgccgcgctgctcgccgtcgccgcgtgatttataccggtcggcgggccggttggtcgagttgcgttggatttgagttcgtgaatgtccgtcctgtacgcgtgttgtctcgtgtgtgttgtccgttgcagcgaatttgcaagtaataataataaaaattatgtccggtaggttgtgc

SEQ ID NO: 83055 - DNA, 309 bp, Zea mays
  Clone ID: LIB3114-044-P1-K1-C11
actgtactcctgcagtaccggtcctgaattcccgggtcggcccacgcgtccgaaaaaaaaaaaaaaaaaaaaaaaaaaaaaaaaaaaaaaaaaaaaaaaacatacgctttccgacatcccaataaaccggcgcatacataccacccactacctttcctatacttactttttatttcatctctccttgctatcatttctctctcccccacatacaaaaaccttgcctttaccttactttctctccttcccctaaattccccttctcccccccccctttatatcgactaacctctcactcttcccccttct

SEQ ID NO: 83056 - DNA, 474 bp, Zea mays
  unsure at all n locations
  Clone ID: LIB3114-044-P1-K1-C2
cgcctgcagtaccgntccggaattccctggtgggcgcacgcgtccgccaacattttatttgaaagggagaaaaaaaaaaaaaaaaaaaaaaaaaaaaaataaaagggaaaaaggggaaaaaaaaaaggcggccaaatttgcgcctcccttctttacgttcccttctttctcccccttacatccttccttttagctctcctatattcactcctctttccatttttttccccctttttttctaccaacacctttgcaaaacccctcttattccccttcttattcatcttcctttacatcccttttttaccacctagctttctcccacaaatcccccttcctatcacccttcccacctgtttcccaacttgaatgccccttgtacctccccttttacccccccatttatcccggttacttttcacgttacccccacatttaccacctcccttgcccccgctcttttccctttttttt

SEQ ID NO: 83057 - DNA, 456 bp, Zea mays
  Clone ID: LIB3114-044-P1-K1-C9
tggacgcctgcggtaccggtccggagttcgcggggcggcgccacgcgtccggatcggagttaataagagggtggaggtgattagtgttcacatatggcgtgggatctcggtggttggttgccttctctttttattttcggttcttggtgttcgtgtgtgtcaatcgacttgggggctaacacagcaggatatacagattgttaaggcggtgaaccgattatttacagcttctcttagccaatcaaaaaaaaaaaaaaaaaaaaaaaaaaaaaaaaaaaaaaaaaaaaaaaaaaaaaaaaaaaaaaaaaagggggacaatacaaaaggaaccggaaaaaacctacgcatacctgcaaaaaaataacctattttataaatacacttaaaaaaaaattaggggggcgccgtttaaggaactcactgtttggcttcacccctggcgggaccaaatttttt

SEQ ID NO: 83058 - DNA, 172 bp, Zea mays
  unsure at all n locations
  Clone ID: LIB3114-044-P1-K1-D12
accggtccggaattcccggctcgacccactcatcctaaaaaaaaaaaaaaaaaaaaaaaaaaaaaaaaataaaaaaaaaaacggccnccccttaaccgcgaatcttatcttactaactcttcctttcaacataatattttttttatagattcacctaaattcaattaactcc

SEQ ID NO: 83059 - DNA, 217 bp, Zea mays
  unsure at all n locations
  Clone ID: LIB3114-044-P1-K1-D7
gtacgcctgcagtaccnntcccagttccggggggggcacgcgtccgaactaaatataaaaaaagaaacaaacaaacaaaaagaaaacaaaaaaaaaagcgggaacgagaggaaaaaaaaaaaggaaaaaaaaaggggcggcccttctaaaggatccaagcttacttacccgtgcatgcaacgtcaaaccttttttataggggcacctaaattcaatt

SEQ ID NO: 83060 - DNA, 270 bp, Zea mays
  unsure at all n locations
  Clone ID: LIB3114-044-P1-K1-E12
cccgcggcgacccacgcatccgcactagaactcaatccctaacaaacaaaatttatagcaccaaaccaacaaacgcaacccgcctatttctaatataatatcacctaaccccaaaaaactnnccaatnttcaacaacatacaaaataataaaaacccaaaacctatcccaatgctcctccccttccaacacatcccccttcccccatctcccacataattaataaccaataaaccattaccccttcccaacaattacacatcctaaatct

SEQ ID NO: 83061 - DNA, 146 bp, Zea mays
  Clone ID: LIB3114-044-P1-K1-E4
cacgcgtgcgaaaaaaaaaaaaaaaaaaaaaaaaaaaaaaaaaaaaaaaaaaaaaaaaaaaaaaaaaaagggaaaaacgcaaaaaaaaaaaaaaggaaaaaaaaaaaaaaaaaaaaaaaaaaaaaaaacaaaaaaaaaacgaaaaa

SEQ ID NO: 83062 - DNA, 267 bp, Zea mays
  Clone ID: LIB3114-044-P1-K1-F10
acgcgtccgcgtttatgcccctgctgcctctgcgtgacggtgctgctggaggtggccgtggagctcggcaaggcgccgctccatgtcatgacctggtttacctccaagatcccctgctagctgtcccctgctttctgctgtgcggatcatacatacatcttgctttagccggagagggtgctgtactgtactggactggtgtttcgtttcgtcgtcgcttggtccgttcgtcctagtgctactttgggtttctgcgattgatttttc

SEQ ID NO: 83063 - DNA, 441 bp, Zea mays
  Clone ID: LIB3114-044-P1-K1-F4
gggggagccacgcgtccgaaaaaaaaaaaaaaaaaaaaaaaaaaaaaaaaaaaaaaaataaaaaaaaaaaaaaaaaaccggcaaccgcacaattattaaaatagcctacaccttccttcctcccactttccactttctttactattccaaaacttacataatctatagcgccacctaactcaatttccattcccaaaattttccaattcccaaccttattaaactctaacaacacccaacttattcccctttccaacaatatccctatccccatctcacttattactcctaaatattcaccaccaattacctttccaaaaatactcccccccttacacctaattaataccctctcttttactggttattacccccactttccattttttttttttacctttttaaccccccccacttcccatccctttaaccctttctttt

SEQ ID NO: 83064 - DNA, 437 bp, Zea mays
  unsure at all n locations
  Clone ID: LIB3114-044-P1-K1-F5
ctgcggtaccggtccggaattcccggggggggccacgcgggcgcatggattactgatcctatgcatggaaacaccatcaaggccccttgtggcctgaagacggggtccaggcgactcaattctggctgaagtgcgcgcattcttcgacgtgcatgatcaagaaggaagtcacccaggaggcatccaccttgaaatgactgggcagaacgtgaccgagtgcattggtggatcacggactgtgaccttcgatgacctgagcgaccgctaccacacccactgtgacccaaggctgaacgcctcccagtccctggagctcgccttcatcattgcagagaggctcangaagaggaggatgcggtcggggctcaacaacagcctgcctctgccaccactggctttctaagtagccgaagctgaacagagaaggtagagggata

SEQ ID NO: 83065 - DNA, 175 bp, Zea mays
  unsure at all n locations
  Clone ID: LIB3114-044-P1-K1-F6
tacgccttcagtaccgttccggaattcccnggtcgagccacgcgtccgggtcatgccaactttagggcaaaaaataaacatacttatcatgacgctttacatttaaaggaacgggataagtataatatagaaaaacctatatacactctcatgcatcccatttttatcttttttt

SEQ ID NO: 83066 - DNA, 93 bp, Zea mays
  Clone ID: LIB3114-044-P1-K1-F7
aaaaatggggcgggcgctttaaataatccatctttactttcccgtgcatgcaactttatatcttttttatagggtaacctaaattcaattcat

SEQ ID NO: 83067 - DNA, 159 bp, Zea mays
  Clone ID: LIB3114-044-P1-K1-F8
cgcgtccgcccacgcgtccgatcaattctagggcgtagaggcaaagtaagattagccagggagattaggcagctttcgctcgataatgtccaacttctattaaacacattaacaaaaagattgagtggtgaagaaaaaaaccctgacaaaacccaactt

SEQ ID NO: 83068 - DNA, 197 bp, Zea mays
  Clone ID: LIB3114-044-P1-K1-G12
ccctcgacccaccatccctaaaaaaaaaaaaaaacaatctaaaaaaaccaaacttacatattcttccccgccactagaaaattcacctatacataccccctcatcccacttcattcctcttctatacacacacctaaatttaataaactccccctcctttcccaacctaatccccttgaaaaccaatccctttccca

SEQ ID NO: 83069 - DNA, 229 bp, Zea mays
  Clone ID: LIB3114-044-P1-K1-G2
gggccccaaaaaaaaaaaattcatattaaatgttttttactaaaccatatttttcaaacaacctactattttaacccattaacaacccaacttaatccccaacatcacatccccctttcatcagctagaataatacccaagatgcccttaccaaaacgttcttcccaacatattcgcaaactgaatcgcccatgtgaccccccctataaccccgcattaatcgcggttc

SEQ ID NO: 83070 - DNA, 208 bp, Zea mays
  Clone ID: LIB3114-044-P1-K1-H12
aaaaaaaaaaaaaaaaaaaaaaaaaaaaaaaaaaaaaaaaaaacacaattatggctaacgggaggattccttaaacgtgcctccatatataccacctcttttttccgcgctcttaactttatatacaccaccaaaaaccaaattacccccctcctttttcctccttaaagtcccccaaattaatatctctatccccacttttatcctt

SEQ ID NO: 83071 - DNA, 404 bp, Zea mays
  Clone ID: LIB3114-044-P1-K1-H2
aactaattctatataaaaaaacaaaaaataaaaaaaataacaaacatacaaacaaaatacagactaacgcgtaaactctaatataaaaaaaccataaattcaattcattacctcaactattttacaactttattacatgggtccaccccttttaattacccaacttaattcccctttcccacttctccttcttattccttttttccccactcctaaaattattttactcccctgcccttttccaccttcttcacctttaaaaacccttattttccccacttttatcccctttcataacatcccctttttcccatttttactaacaccaaaaacgctctactttatacccttttaaaacattttcccccccctatatcccaatatttccccccttcttccccccc

SEQ ID NO: 83072 - DNA, 399 bp, Zea mays
  Clone ID: LIB3114-044-P1-K1-H5
gcgtccgaaataattttagatactaaaacaaacaatctaaaaaaaacactatcttacatacaacatcacggcaacccgacaactttttatataatatcacctaactccaattcactatctcatcttctacaacttcttaactcctaaaacccttacattacccaacttaatacccttacatcacatccccctttccccatctcaccaactatctaatagcccatctccccccacccttcccaccattcccccatcctcatatcctaattccacacaccctttaccttctcatttaccccttactcttcccctttttactctcaccttaacccctacacttaccacccccctaagccccgctcctttccctttttatccttattttctccccacgttccc

SEQ ID NO: 83073 - DNA, 158 bp, Zea mays
  Clone ID: LIB3114-044-P1-K1-H9
ctggtcgcctgcggtaccggtccggagttcccggggggcgcacgcgtccgaaataaaaaaaaaaaaaaaaaaaaaaaaaaaaaaagaaaaaaaaaaaaaagagagaaacagagaaaagggaaatgggggacataacctaacaatacatccaatttact

SEQ ID NO: 83074 - DNA, 180 bp, Zea mays
  Clone ID: LIB3114-045-P1-K1-A1
cccacgcgtccgcccacgcgtccgaaaaaaaaaaataaaaaaaaataaaaaaaaaaatagtggaaaataaaaaaaaaaaaaaaaaaaaaaaaatataaataattaatataataaaaataatttttattttttaatttaattaataaataaaaaggcccccctttttaaagtttccaattt

SEQ ID NO: 83075 - DNA, 166 bp, Zea mays
  Clone ID: LIB3114-045-P1-K1-A11
aagtaagtaagtacaatatgagtggtcggtcggttacctggagcttgatcgtgatagggtatggtatgtaatttcctcttctcttcttttggctgagccatggatggtgtgcttgtaacaaggatggcttgatgtcagtatactaccctaccataccatggagcac

SEQ ID NO: 83076 - DNA, 153 bp, Zea mays
  Clone ID: LIB3114-045-P1-K1-A12
cccacgcgtccgccccatcttcatcccgttgtcgcagcagcagccatccaagcagcgagggacggcggcaagaagagccggaacccgcacaaggcctccgcggactaccgcagcgaccgcaagtcagcctccgggatgagcggcgaccccaag

SEQ ID NO: 83077 - DNA, 189 bp, Zea mays
  Clone ID: LIB3114-045-P1-K1-A2
aacacgtccgcaaaaaataaataaaaataaaaaaaaaaaaaaaaaaaaaaaaaaaaaaagagggaaaaagggaaaggcggtcgttcaaaaatgatcccctctttcatacgcgggccgtcccgttttaaagcttcctgtcttatgtccccttgctttccaacttcttaccttttttttactcccccctaa

SEQ ID NO: 83078 - DNA, 197 bp, Zea mays
  Clone ID: LIB3114-045-P1-K1-A3
aaaaaaaaaaaaaaaaaaaaaaaaaaaaaaaaaaaaaaaaaaaaaaaaaaaaaaaaaaagggaaaaatggaaaaaaacaagtgggtggggcccccccttttttaggttccaactttcctttcccgtccatgcgccgtcatattttttttttggggccccctaaatccatttcattgcccctctttttccaccttttg

SEQ ID NO: 83079 - DNA, 127 bp, Zea mays
  Clone ID: LIB3114-045-P1-K1-A6
acgcctggggacccctgcacggaccggcccggaagacccaggggggggcacgacgttcgtccacacgtacgacccaacttcatatccggtgtcgcaacaacaagcattcaagccacgggggaacggg

SEQ ID NO: 83080 - DNA, 116 bp, Zea mays
  Clone ID: LIB3114-045-P1-K1-A8
tcccacaaatacaaaaaaaatatttaataaaaaaaaaaaaataaataaaattaaaaaaaaaaagagaattagggaaaataaaaaatgataactatttatctcctttttaattttta

SEQ ID NO: 83081 - DNA, 379 bp, Zea mays
  Clone ID: LIB3114-045-P1-K1-B11
agctatagatagagagcgggcggtctatatgaaccaagcatacttacgcgcgcatgcgagggaatagatattttatagagacacctaaataaaattaactgaccggccgtttacaaacaacggactggcaaaacaatcgctgtacccaactaaattaacttgcaggacatacatctttcttcagctggctgaataaataacaggcaggcaccgatcgatcttcctaacaaacaggcaggctgaatggataatgggacgcaccctgtatcgacgcattaatcacgggcggtgtggggggtacgtacacccagaccgatacacttactagcgcgctagctaccgctcctttcgttttctttccttcctttcttgccacgca

SEQ ID NO: 83082 - DNA, 407 bp, Zea mays
  Clone ID: LIB3114-045-P1-K1-B3
aaaaaaaaaaaaaaaaaaaaaaaaaaaaaaaaaaaaaaaaaaaaaaaaaaaaaaaaaaaaaggaaaaatgagaaacaaaaaaaaaaaaaaaaaaaaaataataaataaaaaaaaacataaaaaaaaaaaagggggcggcctttttaaaggttccatgttttctaacccgtctttccaaacctatttttttttttttgggccccctaatttaatttcatgggccgggtttttaaaacttgggccttggaaaaccctttgcttacccaattttaattcttttgggcaaattccctttttccccaattgggttattaagaaaaaggccccccccatttccttttccaaaaacttgtccacttttaatggcaattgggcccccccttttacctttctttaaaccccggggg

SEQ ID NO: 83083 - DNA, 408 bp, Zea mays
  Clone ID: LIB3114-045-P1-K1-B5
ggaaaccttggacctcctgaacactacagctacccagaaggaaattatggtggttgcgaaagtcctgtggggagatccgcgtgagaagctctgtcaagttatccatgacaccccgttgagctgcttggttataggaagcaggggccttggcaaactcaagagggtgctcttaggaagtgtcagcgattacgtcgtgaacaacgcaacctgccctgtcaccgttgtcaagtcatcaagcaccgaaggttgatctcatcaccgaaatgcctgaatattgctgttgttataataaaagatggttggcctcatgaagaacatgcactagtttctagctacctgaaacatgttgaaccgggcaatcctattgtaataatagacaaagtgccttatgaagggcatggttatgta

SEQ ID NO: 83084 - DNA, 104 bp, Zea mays
  Clone ID: LIB3114-045-P1-K1-B8
gactaaatatagatacaaaaacagactatataaaaagaaacaaacttacaggcacaaaacgggcaacgacataggtcttatataaaatcacctaaaattcaatt

SEQ ID NO: 83085 - DNA, 170 bp, Zea mays
  Clone ID: LIB3114-045-P1-K1-C11
aaaaaaaaataaataaaaaaaaaaaaaaaaaaaaaaaaaaaaaaaaaaaaaaaaaaaaaaaggaaaaaaaacaacctcaaatataaaataaagccaaccttaattatagtggccatctttttacaccctttttttactttggtatacccttttttttctttcctcttttt

SEQ ID NO: 83086 - DNA, 107 bp, Zea mays
  Clone ID: LIB3114-045-P1-K1-C3
gactaaatatagaatacagagagcggacgatataagagagaaccaagcttacatacaacaaacaggcaacataataagctcttctatagtgaaacctaaattcaatt

SEQ ID NO: 83087 - DNA, 204 bp, Zea mays
  Clone ID: LIB3114-045-P1-K1-C7
aacaaaaaaaaaaaataaaaaaaaaaacaaaaacaaaaaaaaaaaaaaaatcgcaaacaagcgaacacatacatgcgaaaaacataacatatactataatatcacctaaaataaaaaaatactggggggggcctttcttagggaatcactgttctcccccctgcccttacccaacttattcttttttctgctcacccccatttc

SEQ ID NO: 83088 - DNA, 414 bp, Zea mays
  Clone ID: LIB3114-045-P1-K1-C8
cccacgcgtccgaaaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaaaaaaaaaaagggggggcctttttaggggatccaagttttcttcccggggtttgcaacgtattattttttttttgggggcccctaaattaaattaattggccgggtttttaaaacgttgggtttgggaaacccctggggttccccaatttaatcgctttgaaaaaattcccttttttcccggttggggtaataggaaaagggcccccccctttcgcctttccaaacatttgcccacccttattggcaatggggccccccctttttccggccctttaagcccggggg

SEQ ID NO: 83089 - DNA, 359 bp, Zea mays
  Clone ID: LIB3114-045-P1-K1-D12
aaataaaaataaaaaaaaaaaaaaaaaatataaaaaaaaaaaaaattaaataggaaataaggaaaaaataaaaatatattaatataataaaataataaataaaattattttaataataattttacggggggcctttttttaaattccctatttttcctccctcttttttgccatgtataatttttttttttggttcccttaattttatttttttgcccgtttttttaaactttttttttttgaaaaccccttgtttcccccattttttttttttttttgttatttctttttttcctttgtgggtttattttgtaaaggtcctttctttttttctttttcttatttttctattctttttt

SEQ ID NO: 83090 - DNA, 412 bp, Zea mays
  unsure at all n locations
  Clone ID: LIB3114-045-P1-K1-D2
ggcggtagcaagaagcaggatggcaaagcaagcaagaaggagaacactagctccaagaaggccaaagctgatgttcgggagggagatgaagcanaaggttctaacaagtcaaaatctgaggttgaggatgatgagcaggatggtaatgaggacgaggatgagtaaatagtacgatggggaacagcagctttgcaattgagtgtttgctgctttacttatttttctatatgctgttccttttgatgttatatgctgtaaggaaaatctgtacatgatggtaccttagggtatggcatgctggagttcccctttaacccgaagagccggatacttttgccagcctcgtcagcatgtgtaaacagttgttttcttgttttatcgacttattgggtgactacccaagagttggttt

SEQ ID NO: 83091 - DNA, 408 bp, Zea mays
  Clone ID: LIB3114-045-P1-K1-D3
gacaataacaagaaaacaagatggcaaaacaagcaaaaagaggaaacactaactccaaaaaggccaaaggtgatgttcgggagggaagatgaaacaaaaggttctaacaaagtcaaaatctgaagttgaggatgatgagcaagatggtaatgggggcgaggattaataaatagtactatggggaacagtagttttgcaattgagtgtttgctgctttacttatttttctatatgctggccctttttatgaaatatgctgaaagggaaaacctgtgcgtgaccgaaccttatggtctgggatgctggacttctttttttaacctgaagagacggatactagtgccagcctcgtcaccttttcaaaacagttgcttccttgattgataaactgatcgccccactacccaa

SEQ ID NO: 83092 - DNA, 399 bp, Zea mays
  Clone ID: LIB3114-045-P1-K1-D8
accaagtttgtaatggatgaggtctatgacatggagctctacgagtggaccaaggtgggcatctctgatgaggcccaaaaggagcgtgtcaatgccatgatcgaggaccaggaacccttcgagggcgaggccttgcttgacgcgaaatgcttcaagtgagtgtgctgtatccagagctgtttagccctctaattggatgtctatgttgatctggtatatcttgctatgaactggttaaagtttgtgctggtttgagaatttttgtttaccttgtcatcatttaagtgtttcgccgtaacaattttggtcatgtttttgaatgcctgtttgtattcgcgtcgtagttggggctatttatgcagactatccgatttcaaaaaaaaaaggacctaaaaataa

SEQ ID NO: 83093 - DNA, 326 bp, Zea mays
  Clone ID: LIB3114-045-P1-K1-D9
ctcttctcttctggggagacgtaatgtaacgaagaagaatgtgtcattgtggcctgtgggacaaaccctgctgtgtatgggcctgtctataagaaacagcgatgagttgtgacgttatgtttctgacaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaagctatgaaacaggaaaaaaaaaaaagggggggggcggttttaaaggttccaatgttactaacccgggcgtgcaaagaataaatttttttataagggaacc

SEQ ID NO: 83094 - DNA, 170 bp, Zea mays
  Clone ID: LIB3114-045-P1-K1-E1
tggggcgcctgcaggtaccgttccggaatgacccacgcgtgccgttcacattcaaatcccaactggcttcgatcccttcacttaggccaatgcttgggactcttgtgcggcagcaaggtcaaaggactacgtacacgttcccattcaacaacgtaatggtcgcaagaacc

SEQ ID NO: 83095 - DNA, 403 bp, Zea mays
  Clone ID: LIB3114-045-P1-K1-E10
atgcgcagcctgtgctcggcattccagttcctggccatgtcgctggcgtactacgtgaacacgctggtggtcgcattggtggcgtccgtgaccacggcctggggcggcaagggctggctccccgctgacctcaacgacggccacctggactactacttctggctgtggacggggatcagtgtggtgaactacgtcgtgtacacggcatttgcaaggcgttatacggtcaagaaggttgtcggtcagtaaggatccagactatctgtatgatcaattactgtatcttattgtattttgcagtgtacactactccggaaccgagacttttggtgttcatttgaatgcatggtcctctgtacaagcctactagcgtactgtcttgtcttacgatttgtataacatt

SEQ ID NO: 83096 - DNA, 385 bp, Zea mays
  Clone ID: LIB3114-045-P1-K1-E12
gtggagcatatctatctggctgtgtactgcaagcaggcctagtacgccgggggcgcggggctcctattacacatataggcccctccctgcgtgtatgcttgttaccgtcgtgtcgaaccttgtactacgaggctccatcgaacatcgatggcttgcttctttatcagaacatgtttgaataaacgctatttggtaaaaaaaaaaaaaaaaaaaaacaaataaaaaaaaaaaaaaaaaatatgaaaaataggaaaaaaaaatatatgaaaaaaaaaataaaaattaaaaaatgataataaaaaaaatgggggggggcccttttaaaggttccaattttaccccccggggtatgcaaatttatatgtttttttttgggtccccaaaa

SEQ ID NO: 83097 - DNA, 361 bp, Zea mays
  Clone ID: LIB3114-045-P1-K1-E3
aataaaaataaaaaaaaaagcaaacaatataaaaaaaaacaaacatacatacacaaaacatgcgacatgaggaaatattatatagggtgaccgtacatacaattcactggcacgtcattttacaacaatcattactgggaaaaaccctggcatataccggggtggctctttttgaagaacaatccctcttttcccagctggcggaatatctaatttttttttttccgacccccattcccaacatgtgcgccgcctttataaccaatgggactcgcaataccccgggtcttccccccttaattcttgtgcggatacccccttttgtgccggtgcgtttatcagcaaagtgcccccccctcct

SEQ ID NO: 83098 - DNA, 349 bp, Zea mays
  Clone ID: LIB3114-045-P1-K1-E4
gtggtggcggcggctacggcggtggcaaccgtggcggcggctacggcaactccgacgggaactggaggaactgagcggtggggcccgcgcggccaagttatcctgttcgctaccgtgatgtttaccctagtccagagggtttatcttcgttcgtgtcgtgtttgttgttgcccatctgtgtttttgattgcaaggtcgctctgtgtcagttgttagtgctgtgttcatcctcggtttcagcagacccatgcatcaaacagcatggactgcggatcgatggatgctgttacccccgtcaggctttattctaagttaatcttaaggaaaaaatggtgcttcttggtgctgc

SEQ ID NO: 83099 - DNA, 94 bp, Zea mays
  Clone ID: LIB3114-045-P1-K1-E7
ttttacgcctgcatgtaccgttccttagttgggggtggagccactcgtcctaaaaaaaaaaataataaatataaaatttaataaaaaaaaataa

SEQ ID NO: 83100 - DNA, 218 bp, Zea mays
  Clone ID: LIB3114-045-P1-K1-F1
cgggagaaccaatgggcgtcaaaagaaaaagaacccgttctcgttcctgtggcctttccgctcatcaagtagttctcgctagattagcctctggtaatctttgctcaggttcgaaatactgtttgtttttttgggtcaaatacgctggtctaatgggctttaatgtggtgggatctcaatctgtactgtatggtttgttaatgatcgccacacgatgc

SEQ ID NO: 83101 - DNA, 339 bp, Zea mays
  Clone ID: LIB3114-045-P1-K1-F10
aaaaaacaaaaacaaaataaaaaataaaataaacagataaaaaaaaaaaaaatgaaaaggggaaaaagaagggggggggttttcgaggatccagattctagtactcgtgcatgcccagtaatgactattttattgggcaatctaaatccaatgctttgttgatcggtttacaacctctactctgttaaaacgctggcgtttccggaattaatcgcgtttcgactgatccccctttcaccatgtggggtaaaagcgaaaatgcccataccgatggcccttccaaacatttggccaacgtgaatgggtattgggacacgccctgaatcggctcattaaccc

SEQ ID NO: 83102 - DNA, 411 bp, Zea mays
  Clone ID: LIB3114-045-P1-K1-F3
cccaagtttgtaatggatgaggtctatgacatggagctctacgagtggaccaaggtggacatctctgatgaggcccagaaggagcgtgtcaatgccatgatcgaggaccaggaacccttcgagggcgaggccttgcttgacgcgaaatgcttcaagtgagtgtgctgtatccagagctgtttagccctctaattggatgtctatgttgatctggtatatcttgctatgaactggttaaagtttgtgctggtttgagaatttttgtttaccttgtcatcatttaagtgtttcgccgtaacaattttggtcatgtttttgaatgcctgtttgtattcgcgtcgtagttggggctatttatgcagactatccgatttaaaaaaaaggcggataatacattaaaaaaaggggggg

SEQ ID NO: 83103 - DNA, 362 bp, Zea mays
  Clone ID: LIB3114-045-P1-K1-F4
aaaaaaattaaaataggatagaagactataacatgaaaaatataaaagtgaaccaaaagaggggatatctggtgaggcccaaaaggagcagtatcaatgccatgatctaggaccaggaacccttcgagggcgaggccttgcttgacgcgaaatgcttcaagtgagtgtgctgtatccagagctgtttagccctctaattggatgtctatggcgatctggaatatcttgctatgaactgaaaaatgtttgtgctggttttataatgtttgtgtacctttgcatcatttaagtgtttcgtcgtatcaataatggtcatgtttttgaatgcctgtttgtattcgcgtcgcacgtggggttatgga

SEQ ID NO: 83104 - DNA, 158 bp, Zea mays
  Clone ID: LIB3114-045-P1-K1-F9
aactaaaaataaaaaaaaaagaaaaacaatataaaaagaaacaaactaacaaacgaaaacaggcaaaaaaataaggggtggtctttttaaaggaaccaagcttacatacgcgtgcatgcaaacaaataccttttttatagggccacctaaattcaatt

SEQ ID NO: 83105 - DNA, 385 bp, Zea mays
  Clone ID: LIB3114-045-P1-K1-G10
ctggtcgcctgcaggtacccgtccgaattcccttgtcgacgcacgcgtccgaaaaaaaaaaaaaaaaaaaaaaaaaaaaaaaaaaaaaaaaaaaaaaaaaaaagaaaaaaagaagcaataattatgggggtgcaccaccctcccattcctcttttctctcctacctctttctctttttttctttgtttttctctcttctctttctttctcttcttgtaccttccctttgctttctttctcctccgtcctctttcctctcactctccttcttttcccccttctcctcttatactcccctcctcctctctttctctccctttccctcccttttctctctcctctatctccctgcttctctcactctcgcgctctagctactctctct

SEQ ID NO: 83106 - DNA, 302 bp, Zea mays
  Clone ID: LIB3114-045-P1-K1-G2
agaggatatctaggtggttttggcaatgtatttagtgattttaaccattcaccctctaatgcaaaggaatacccccttgccttgccatcacgattattttgtcctctttctgttgccttggcaagtcaagattctacatatgcatattttaaaattgctggactcatgtatgctaaaaattgtacttatttacgcagttttgattctgttttatgcttaaaaaaaaaaaaaaaaaataaaaaacaaaaaaacaaacaaaatggcaattggtacgcgccctaaatctgcgcttttcactctga

SEQ ID NO: 83107 - DNA, 193 bp, Zea mays
  Clone ID: LIB3114-045-P1-K1-G3
cccacgcgtccgaaaaaaaaaaaaaaaaaaaaaaaaaaaatataacaaatatcaaactataatgaaaaggggtacccacttgactggtcatcactattatttcctcctctttttgttgcctccgcaagtttcgattctacatattcatatatcaaagttgttggactcatgtatcctattgattattcttcat

SEQ ID NO: 83108 - DNA, 171 bp, Zea mays
  Clone ID: LIB3114-045-P1-K1-G5
aaaactacaaatataaatacaaaaaaaaaaaaaaataaaaaagggacgacggtcatcaatggcccaatggggcttactgttgcgggggacactattatttttatgtgataaaacctaagtacatattgctgtcacgatggtgtacaacggcaggactattaaaaccttctt

SEQ ID NO: 83109 - DNA, 394 bp, Zea mays
  Clone ID: LIB3114-045-P1-K1-G6
aaaaaaaaaaaaaaaaaaaaaaaaaaaaaaaaaaaaaaaaaaaaaaaaaaaaaaacaaaaaaaacaaaagagaaaaaaataactagccgccaactaaactaaaccttccctccttttttcaaattcccctcctttccttcttctttccctcccccctcttttcttttttctcttccacccctttatttttttttctctccctctctttccccctctcctccctcttacttcccttttcccttttctcctttttaaattcttctttacacctcctctttctttcccttttttactattcttcctctctcccctcttttttctttttttacccattctttttcccttttttcttttccctattttcccctctcctctttcccctttttttttcccc

SEQ ID NO: 83110 - DNA, 352 bp, Zea mays
  Clone ID: LIB3114-045-P1-K1-G9
aaataaaaaaataaaaaaaaaaaaaaacaatataaaaaaaaaaaaaataacaaacaacaaggataaaaacatcataaactattatatatttatcaccttaatttaattctctatacatcctctttcttccttaaaactctaaatatccctttctttatttggcttcctttttttaaactcccatttctttttcccctttttttcttttattatttttttttttttcccccccaattttctttctccttcccccgttttttctcccctttttttttgtaaaaactctttgccctcccccctcttttattcttttttcaaaaactcccccttttttttccctcctttttttttt

SEQ ID NO: 83111 - DNA, 310 bp, Zea mays
  Clone ID: LIB3114-045-P1-K1-H12
cgcctgcgttcgcctgcacgtaccgtgtccggtattcccgggtcgtacccacgcgtccgtaaaaaaaaaaaaaaaaaaaataaaaaataaaaaaaataaaaaaggtttaaaaaaaaaagggaaaaaaaaaaaagtagaaggggtgcggcctttttaaacttccattcttacctcccccttcttccttcgggccccttcttttatagggcctccctaattttatccactggccgttttttaacatcgttgttgttggaaaacctttgtctttccccaacttaactcttttagcaaaacttcctcttttccc

SEQ ID NO: 83112 - DNA, 411 bp, Zea mays
  Clone ID: LIB3114-045-P1-K1-H4
gaataaaaataaataaaaaaaaaaacaatataaaaaaaaacaaacttacaaacaacaaacaaacaacagaggtggctgttctatagggagacctaaatttacattcctgtcccatacaattacaaccttcattactggtaaaaccctaacatatcccaacttcatccccttttagcccatcccctcttttacacctggccttatctctaataagtcccctccgatcacctttctcaatagttgcccaatcttaatgtcaaatgggactctccctttatccttccatttaaacacccttgtctttttttattattacatcgtgcctgctacaatttttttaatcctttctttcttatatttttactatctatatctttctttcttctacacattcgcctgaccttccccttc

SEQ ID NO: 83113 - DNA, 275 bp, Zea mays
  Clone ID: LIB3114-045-P1-K1-H7
aaaaaaaaaaaaaaaaaaaaaaaaaaaaaaaaaaaaaaaaaaaaaaggacgggggatctgggggaaccaagattacgtgcgcgggcgtgccactttagagggtccacgttttcgtccccttgcttgcgggaactcgccttttttttagagcgccctaaattgggaaaactgggcggtttcttacaataatgggcttgggaaacccccggctttccccagcttaattgctttggaggaggtccccttttatcgcgctggccaacaattgaaaaggc

SEQ ID NO: 83114 - DNA, 399 bp, Zea mays
  Clone ID: LIB3114-045-P1-K1-H9
ggaatggaagggtggtgccgtggtggctggtgtcgcgcgcgctggatgggggctgcccgtgctgggtttgtgcggggagtcgatatggtgccatttgtaaaatccgccattccttgtttttcttcttcttcttcttctttcttattgggtttgtaccgttgtgtttcacaaaagaaaggaacgtttcgcagattaaaaaaaaaaaaaaaaaaaaaaaaaaaaaaaaaaaaaaaaaaaaaaaaaaaaaaaagaaaaaaggaacacactctaaaaaaaattaaataaacactataataagttataaaaaaatattagggggggggccctttttagggaacaaagttatctaacgcgtgcttgcaacgttaaattttttttttggggcaccccaaaataaat

SEQ ID NO: 83115 - DNA, 392 bp, Zea mays
  Clone ID: LIB3114-046-P1-K1-A1
cggacgcgtgggttttttttttttttttttttttttttttttttttttccacacaaaggggggggtatggataagattatagatggatggggacacaacacagcagggcacatggctagcctgctagcgtgcggcacccacacaacacaacacactgttcgccaaaagcgccccaggaggccaggggaggacacgacgccgccatcagccatcatcatcatctcaaactcaaagcatgccatggcacgcaactgactgactgactcaaaacacacacagggacgccgctatactttattaagctttataattaggtagcttcctccggccggcctgcaggggggagcacctaactcacttgccgcatttgcaggggtcgcactggcaattgc

SEQ ID NO: 83116 - DNA, 81 bp, Zea mays
  Clone ID: LIB3114-046-P1-K1-A2
aaaaaaaaaaaaaaaaaaaaaaaaaaaaaaaaaaaaaaaaaaaaaaaaaaaaaaaaaaaggaaaaaaaaagaaaaaagaaa

SEQ ID NO: 83117 - DNA, 461 bp, Zea mays
  Clone ID: LIB3114-046-P1-K1-A3
ttccctgttcgacgcacgcgtccgaaaaaaaaaaaaaaaaaaaaaaaaaaaaaaaaaaaaaaaaaaaaaaataaaaaaaaaagaggaaaaaaagaaaataaaattataaataaatggaaattgtattccctttttttggttccccttttttttcactccttttttcccttatcttaccttttctttggcttttcttttctttgagttaccctaatttcattttacttcccttttttttgctactccctggctttacccatctttattgtccccaattttttcccctttctcccacctttccttttttctgaatagttcttaacccatttctcctcccctctttttcccccctatatattggtaattacactcctcctttattgtccccttttttgccgcctgttttgcgtgtcttgtcttttttcccctccctttttcaccccctttttctccctttccct

SEQ ID NO: 83118 - DNA, 283 bp, Zea mays
  Clone ID: LIB3114-046-P1-K1-A4
aaaaaaaaaaaaaaaaaaaaaaaaaaaaaaaaaaaaaaaaaaaaaaaaaacactataaaatgtaaaaatggtaagttcacatactcggggctgcctcttttttactttcctttttctctaccccttatttcctttccctttcctcttttatatctccaccttttttcaatttacccttcccgtttcttaaaattttggggttgataaacctttttctttccccaactttttttttttgccttactccccccttttttcccctttttaacatattcttatttcc

SEQ ID NO: 83119 - DNA, 283 bp, Zea mays
  Clone ID: LIB3114-046-P1-K1-A7
cccctgatgagctggagatggaggacggcgacgagatcgacgccatgcttcaccagaccggaggcagcgttcctagcaccacctaaaagcctcgttttgctctccgtcctgcgtagtactaaacaaaagggaaaaagtctttttaaggaacttgtgatgctctggctccttgtgccattgctgagggacatccttagcctttgtttagtagtatggtttggtactttgttctgtcatcactcgtttatctatccctaatacatgccgccatgattgtactccc

SEQ ID NO: 83120 - DNA, 432 bp, Zea mays
  Clone ID: LIB3114-046-P1-K1-B11
gcttccgccgggactgcacctacggcaagctcgccgccatgaggctccccaaggacgtcgagggtctcggctcctgcgagtacacgatggagcgcggggtggtgcacgcgtgccacgccggcggcgtggtgcactgcctggaagggtgggagcaccacgaggtgggcgccctcgaggtggaccggatcgacgtcgtgtgggaggcggcgctcaagcacgggctcacgccggcgtgagcgggagggcgcccggagcgggagaccgagacggccggcgcgcgcggccccgcccggaaataacgcgtcgtctattcgttgtcgcatggctgttgcgacgggtgggtcggtgtgctaccgtgtactactactaccagctactagctaccatagtccaagactgctgcaagcgcaatgcaacagagttgataggctg

SEQ ID NO: 83121 - DNA, 148 bp, Zea mays
  Clone ID: LIB3114-046-P1-K1-B4
gtgattgtgtgtgagatgttttatgtgaaaatatgttgtgctcaaaaaaacacaaaaaaaaaaaaagggaaaataaaaaaaaaagtaacataaatttaaaattattttacataattttcacatcttctcaaactgggagacccctttt

SEQ ID NO: 83122 - DNA, 286 bp, Zea mays
  Clone ID: LIB3114-046-P1-K1-B5
gtaaaaatataaaaaaaaaaaaacaatacaaatacaaaaaaaaaaaaaaaaaataataacagaaattcctggtggaaaaatccaagtgagaagctcttttccattatccattactccccttttgtgcttctttttttttggaagcagttgtccttggcatactcataatgtttctcttttgaagtgttatccattacttcgtgttcaacgcaaccttccctttcaccgttgattagtaataaagcacctaacgctttttctcattacctatattctttaatatttc

SEQ ID NO: 83123 - DNA, 198 bp, Zea mays
  Clone ID: LIB3114-046-P1-K1-B7
tggtggtgcaaatgggcaaaacctatgaagtggaaatcacaggcaatctatccgcctacgagactgaagctccggattaatggctgtgtcaaccacggcaactctggccattgtgtgttcaccttcacctaccacatatatactgctaaggtacagccgtacgggtctacagctcaccatggacctgtcaatgtcgac

SEQ ID NO: 83124 - DNA, 187 bp, Zea mays
  Clone ID: LIB3114-046-P1-K1-C10
agtatacagagctgtaaaccggtgatgcacattcatgcttcatctaaaagaaccgataggaatggcctttgacggccttcctccctcatatcttttttagatcatagtttaatttcacttttacttactttttttttcaactttaatgcatgtaaaaactttgacctatccttaccttaattttttt

SEQ ID NO: 83125 - DNA, 181 bp, Zea mays
  unsure at all n locations
  Clone ID: LIB3114-046-P1-K1-C12
acgtttgaactttgttcgtttgtattgcactattgcttgttgtttaagtagcggttaagggagggagtcgtacgctgtgctaccataatggaagtactccggtccggtccggtcctgtgtgagccttatgtacgtgcaattttaatgtcttttgatattacaagactcgacggttggcant

SEQ ID NO: 83126 - DNA, 376 bp, Zea mays
  Clone ID: LIB3114-046-P1-K1-C2
gaggaactcggcgagctgcggcagaagagggaggccgaggagcaaggcaggggcgcttggttgagagcagaatatggacaccgatgggatttttatccagggtggccgagtggatgggaacgaggcaacgacggtgagaaaaatcttgagcagagcgtcggctgcgaggataagcacggccaccggcggacagatttttgttcccagcaaccggagcggatgaggacgaccgggtgaaggaagcagaggtgagcgctcgggaagaacagctgtagagatttttttttttattttcttttctcctttttttacagaaaatcatagatatttttgtgtctggatttttagcaatgcacactggatcgatacactattc

SEQ ID NO: 83127 - DNA, 386 bp, Zea mays
  Clone ID: LIB3114-046-P1-K1-C3
gagtaactttaaaaaataaaaaaataaaaaaaaaaacaaaaaagaaaaaaaatttctctgcgtttaagaggagaattttaacacgctggtgggatttttatccatggtttcctttttgttataatactatcatctatctgtacatatttcttgattagatcgtttgttgtcaggataagcactgacatccttcgtacagatttttgttcccagcattcctatcgtatgatgtcttcctgatgaaggaatctctagtgtgcactcgttattaacatctttatatatttttttttttattttcttttctcctttatttacaaaaatatattgattcttttttcttttatatttttaacaattctcacttgatcgattcacatattttt

SEQ ID NO: 83128 - DNA, 448 bp, Zea mays
  Clone ID: LIB3114-046-P1-K1-C4
acgcattccgcgacctggaccccatcgactcgccggcctccatggcgtcctcgaagaaggttgcgacccgtgacgagtgggagcggaagcttcgcgacgtcaagatacgcaaggaggacatgaaccgcctcgtcatgaacttcctcgtcactgagggcttcgtcgacgccgccgacaagttccgcatcgagtccggcacccagccggagattgacctagcgatcatcgcggatcgaatggaggttaagagagcagtacagtcgggtaatgttcaggaagcgatcgagaagatcaacgatcttaaccccacggttcgattctgtctatgttcctagcaaaattagttcgaataacggccgagacgtactttgttgtggaagatctccaagtaggttgtggttgctgggttgtacagatctggttttcatcctcctgtaagtctgaaata

SEQ ID NO: 83129 - DNA, 282 bp, Zea mays
  Clone ID: LIB3114-046-P1-K1-C5
agaagaagaagaaaaaaaacataataccctgcgttcctgctgccccggctgtctggcccccactactgccaccgacggcggcgccgaacccccgttccaatcatcatatcgtagacgacgcgcagcattaaactatcaatcaccggatctggctctttcttggccctgtactgtactattaatgttccgttcttgtttttttattcggaattgtcgccgtttcagtatacgtaaatctcgaggtcgataatacagtaatactaccaatttaactgtataaaa

SEQ ID NO: 83130 - DNA, 378 bp, Zea mays
  Clone ID: LIB3114-046-P1-K1-C6
aaaaaaaaaaaaaaaaaaaaaaaaaaaaaaaaaaaaaaaaaaaaaacaaaatatataaaaaaaaatactggaaccatacaaaagggggcaattctctcattctaatacttatatctctaattttttctcttttttctcccatttatttcttctctcttgctgttttttcatcccttttctgttactttttatgcttttcttcttttttttcttttttccctttccttctaatatttcttcccgtttctcctttatttcactcaattccttcctttcttaccctatatcttcctccctatttttcctctctttaatctctattttttctccctcctttttttattaatctctttgttctactctctccctcctttcttt

SEQ ID NO: 83131 - DNA, 225 bp, Zea mays
  Clone ID: LIB3114-046-P1-K1-C7
aaaaaaaaaaaaaaaaaaaaaaaaaaaaaaaaaaaaaaaaaaaaaaaaagggaaaaatataaaaaaataaaaaaaaaaaatttttataaaaatataataaaattaaaaatatatattaaaaatattaaatataaattaaaaattggggggggcccttttaagtgtccaaattttactcccccctgattgcaagatatatttttttttattgtgccccctattttt

SEQ ID NO: 83132 - DNA, 381 bp, Zea mays
  unsure at all n locations
  Clone ID: LIB3114-046-P1-K1-C8
ctcaagaacgccccaatgttcaagcgccttgaggccaggattaggggtaaaggctcagctgttggtgtcggccgaggccgcgcggtcgccatgcgggctagggctgctgctggtcgtggcggtggtcctgttggacgaggtggtgcaccccctgtgaggaggtagatctgtcgcgctatgtggcaaatcaagcttttgccctagttgcaaaaactttgcttgagcagcgatgctatatggttgttaagggtagcttatcagcagcagttcatgtttacagcatagatgcaggactttgtgtaactttgcacgagaagactgtggacagtttcgacgatgctatattgctattgagggtctgatttggattntnaaaataaa

SEQ ID NO: 83133 - DNA, 66 bp, Zea mays
  Clone ID: LIB3114-046-P1-K1-D3
aaaaaaaaaaaaaaaaaaaaaaaaaaaaaaaaaaaaaaaaaaaaaaaaaaaaaaaaaaaaaaaaaa

SEQ ID NO: 83134 - DNA, 216 bp, Zea mays
  Clone ID: LIB3114-046-P1-K1-D4
cccacgcgtccggagtaaaacctgtttactctgttgagcttgtcacctggtgatgcaaggtgcttattgactggtaatgtattttgaagtcgttatactatctgaaaccccttcctgagcaaaaaaaaaaaaaaaaaaaaaaaaaaaaaaaaaaaaaaaaaaaaaaaaaaaaaaaaaaaaaagtttaattggggaggcggcggggtcttacctttt

SEQ ID NO: 83135 - DNA, 384 bp, Zea mays
  Clone ID: LIB3114-046-P1-K1-D5
aaaaaaaaaaaaaaaaaaaaaaaaaaaaaaaaaaaaaaaaaaaaaaaaaaaaaaaaaaaagaaaaaaagggaaaaaaaaaataatttaaaatttataaatatataaaaaaaataaaattaaaaaaaaatggggggggcccttttaaaaaaccaaagtttacttccccttcattgcaacttattagctttttttttgggccccctaaattaatttaattggccggtgtttaaaaacgtgttatctgaaaaaaccttgggtttcccaaattaaatcgctttgaaaaaaatcccttttttccaagttgggttaataaaaaataggccccacccaatcccctttccaaacatttgcccacccttatttggaatgggaccccccccttt

SEQ ID NO: 83136 - DNA, 299 bp, Zea mays
  Clone ID: LIB3114-046-P1-K1-D7
ctcccgttcgggtccggccgccggatgtgcccgggctacgtcctcgggctcaagatggtgcaggtcaccctggccaacctgctgcacgccttctcgtggaggctgcctgatagcgtggcgccggagaagctgaacatgcaggagaagttcgggctcgccgtgccgcgcttggtcccgctcgaggccgtcgccgtgcccaggctgccaccacacctgtatgccgggccatgatgcatgtctatgtttgtttttgtaggcgcatacaactgtctcgtaataaaagatacatatcttttctc

SEQ ID NO: 83137 - DNA, 440 bp, Zea mays
  Clone ID: LIB3114-046-P1-K1-D8
gctacagcaagatcctcaaagatctcaagaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatggtttctgagcaaccgccgggtccatagcaaaccaaccctgcatgcagggccagcttattatatataatatctgaggtggagcatatctatctggctgtgtactgcaagcaggcctagtacgccgcctgcgcgttcctcctattacacatataggcccctccctgcgtgtatgcttgttaccgtcgtgtcgaaccttgtactacgaggctccatcgaacatcgatggcttgcttctttatcagaacatgtttgaataaacgctatttggt

SEQ ID NO: 83138 - DNA, 234 bp, Zea mays
  Clone ID: LIB3114-046-P1-K1-E10
atgtagttgccctgtgtaacttctgtaattgctttttagttgccttttcgctacatgattgactggcaaagcggtttgtcataaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaattaaaaaaaaaataaacgcgataaaaaaataaaataaaaaaaataaaacgggg

SEQ ID NO: 83139 - DNA, 275 bp, Zea mays
  Clone ID: LIB3114-046-P1-K1-E4
gtggccgcgccggagatcgacggtgcgggaagtgttgtagatgcagagctcagaaatgagaaatgtgagtaggcaacaggatgcgcgtgtagagtgtacgttacgtgtaggtttaggtgcatgcaagtgtaaatacacgggatctccgtgcggtgtgcccagtcacagtttggaactcagcttttattagtgctcgtgttcaggctcaaaaaaaaaaaaataaaaaataaaaaaaataaaaaaaaaatatttaaaaataatataaaatataattt

SEQ ID NO: 83140 - DNA, 265 bp, Zea mays
  Clone ID: LIB3114-046-P1-K1-E8
ggataaggtagcggcgagacgagccgtttaaataggtgtcaagtggaagtgcagtgattaagaggtgtggctaacaaacatttgtctattgactcggttcatgatataaattcggatttggagctttagtaactaaaaaaaaaaaaaaaaaaaaaaaaaaaaaaaaaaaaaaaaaaaaaaaaaaaaaaaaaaaaaaaaaaaaaaaaaaaaaaaagaattgaaagataaacccaacagtttgcgcacacagaaaggtaaaaaggga

SEQ ID NO: 83141 - DNA, 462 bp, Zea mays
  Clone ID: LIB3114-046-P1-K1-E9
aaaaaaaaaaaaaaaaaaaaaaaaaaaaaaaaataaaaaaaaaaaaaaaaggaaaaaaaaaaaaaaaaaaaaaataacaaaaaaaaaaaataaaaaaaaaaaaaaaaagggggcggccgttttaaaggatccaagtttccatacccgtgcatgcaacgtaatagcttttttatagggccacctaaattaaatcaactggccggggtttaacaacggcgggactggaaaaaccctggggttcccaaacttaatcgctttgaaacaaatccccttttcgccaggtggcttaatatcaaaaaggcccgaaccaatcgcctttccaaacatttgcccaccctaattggcaattggaaccccccctgtaacggcccattaaccgcggggggtgtggtggttccccccaagtttgacctttacactttcaagggcccctaaaccccgcttcttttgatttttttccct

SEQ ID NO: 83142 - DNA, 189 bp, Zea mays
  unsure at all n locations
  Clone ID: LIB3114-046-P1-K1-F12
cccacgcgtccgtaaaaatnatnttnaaaaaaaaaaaaaaaaaaaaaaaaaaaaaactgggaattttgtaaattccattctttcctacccctttctttttcccccccttatactcttcctataatttccactctataatacaattcattttaccataacttatacaacttttaaaacaccgcaaaatcc

SEQ ID NO: 83143 - DNA, 76 bp, Zea mays
  Clone ID: LIB3114-046-P1-K1-F3
aaataaaaataaaaaaaaaaaaaaaaaatataaaaaaaaaaaaaaaaaaataaaaataaggggaattttgatatat

SEQ ID NO: 83144 - DNA, 349 bp, Zea mays
  Clone ID: LIB3114-046-P1-K1-F4
gactagttctagcccacgcgtccggaagggataagagggccgcaatcaaagctgcctccatctttgcggagtcatcaagctcagcatcacatggtaaacccgacctcgtgctgaagaggcggaacataaaagctggagccgctacagcactgatggcaggcagggtgaagccgtcctcgtggcagagcgccagttccacgagctcaaggactcggatgcctgttctggcagcacgcaagtaggcagctcgttgcctcaggctttgtgtgggaaatagggggcttgtgaaatatggacttgcccgtaatattgctatgtttctttggttgtactatactcacaaataaaa

SEQ ID NO: 83145 - DNA, 202 bp, Zea mays
  Clone ID: LIB3114-046-P1-K1-F5
aaaaaaaaaaaaaaaaaaaaaaaaaaaaaaaaaaaaaaaaaaaaaaaaaaaaaataaaaaaaaaaaaagggaaaaaaaaagggcgggggcttttttgtgtccaagcttacttacgcgggcgtgcgacttaatacctcttttttccgtgcccctcattcaaattcattggccttctttttacacccctaaatctgttaaatcc

SEQ ID NO: 83146 - DNA, 421 bp, Zea mays
  Clone ID: LIB3114-046-P1-K1-F7
gccaagctcgaggaagctgttaggagtgtccagatggaagggctgctctggggcgcatccaagcttgtcccagttggatatggtatcaagaagctgcaaatcatgatgaccatcgtcgacgaccttgtctctgtcgacactctcattgaggactatctgtgcgctgagccagtgaacgagtacgtgcagagctgcgacatagttgccttcaacaagatctaggcgtgacttccgatcagtccttcccctggggtgctggcgatggtggtggctgggcaatgcaccagcctaatttatccatagctatatgtctgctttgtgtggccagtgatattgccgtgagtatttttggatcctattcgagtcgaatgtaccagtaccagagttaatttgctttaattcgaaacaccgttccagttgg

SEQ ID NO: 83147 - DNA, 397 bp, Zea mays
  Clone ID: LIB3114-046-P1-K1-F9
agtggactagttggcgattgcaacctgcttgtggattactctcccattgtgttatgtgaatctgttaagacatcagcattccctacagcatattttgtgtacctacgtcttagtagttgccgaaatctcaatcaaaatcacccgctattggaggtgaatttcccatgtaatcttctgctcatgtaaatggttttctttttaatgaatcgatgtttatcgccctaaaaaaaaaaaaaataaaaaaaaaaaaaaaataaaaaaaaaaataaaaaaaaaaataaaataaaaaaaaaaaaaaataattttaaaaaataaaaaattgggggggccgttttagaggacccaagtttacgtacgcgtgcttgcgacggaatatttttcttttgggggcacctaa

SEQ ID NO: 83148 - DNA, 370 bp, Zea mays
  Clone ID: LIB3114-046-P1-K1-G1
acagacaatgagtcttgagaatggggagttagtgaagttcccacaagggttttcaaaactgaagaaattgcgacatcttatggtttcacggttgcaagatgtaactttcagcggtttcaaaagttgggaagctgtggagccatttaagggcttgtggactttgattgaactgcaaactctgtatgccattacagcaagtgaagtattagttgcaaaacttggaaatttatcccagctgaggcggcttataatttgtgatgtaaggagtaacttatgtgcacagttgtgtggctctttgtcaaagttgtgccagctgtcacgattaacgataagagcatgcaatgaagatgaagtgctacagctggatcaa

SEQ ID NO: 83149 - DNA, 302 bp, Zea mays
  Clone ID: LIB3114-046-P1-K1-G2
aaaaaaaaaaaaaaaaaaaaaaaaaaaaaaaaaaaaaaaaaaaaaaaaaaaaaaaaaaagggaaaaaaggggaaaacattatggtgggttgacaaattttgggcgcccttttttaaggttcctagttttcttaccggtgcttgcgacatttaaaggtgggggtgggttttacaaaaatccaatttcttgcccggctttttacaacttttgttttttttaaaccctgccttaaccaattttaggggcggtggttaacaaccccttttcgggagaaacccttttgctcacaagttttatccctt

SEQ ID NO: 83150 - DNA, 269 bp, Zea mays
  Clone ID: LIB3114-046-P1-K1-G3
aaaaaaaaaaaaaaaaaaaaaaaaaaacaaaaaaaaaaaaaaaataatataaaaaaaaagtggaataaatatacaacatattgtatctcccctcatttttttttctcctcttctcactattccatttctcttttctctcttcttcttctatatttttcccaaatcttaccccccttaccctcattttttcaccctttttcctccctctcccctctttttccctccttattctcctctttcttccctccctcctttcccctccccccttt

SEQ ID NO: 83151 - DNA, 270 bp, Zea mays
  unsure at all n locations
  Clone ID: LIB3114-046-P1-K1-H2
aaaaaaaaaaaaaaaaaaaaaaaaaaaaaaaaaaaaaaaaaaaaaaaaaacactaaaatgaggaaaaattttattctcttggggtgcgcctttttttcggtttctctgctttcggggtcccttccttttntttcttttgctttttttaccacttcccctcttttttccccccttatttcactctactaccacccgttttatcatctcccttcttgtcccatcccttcttttcccaaacagcttccccctttttcccctttctctttttcc

SEQ ID NO: 83152 - DNA, 108 bp, Zea mays
  Clone ID: LIB3114-046-P1-K1-H3
aaaaaaaaaaaaaaaaaaaaaaaaaaaaaaaaaaaaaaaaaaaaataaaaaaaaaaaaaggggaaaaaaaataaaatatattttggtggggctttctttttgttgttc

SEQ ID NO: 83153 - DNA, 313 bp, Zea mays
  unsure at all n locations
  Clone ID: LIB3114-046-P1-K1-H4
aaaaaaaaaaaaaaaaaaaaaaaaaaaaaaaaaaaaaaaaaaaaaaaaaaaaaaaaaaaaaaaaaaaaggggaaaaaaaaaaaaaggggggntaaaatggggcggccgttttggggggtccttgtttaggtaccacgttatgcaaccgggatatgcattttatagggtcacctaaattaaatccaatggccatttttttacaccgtgtttactaagaaaaccctggggaaacccatgttattccccttgtaaaacatccccctttcaacacctgtttttttagctaagagacccgcacagatggcccttccaa

SEQ ID NO: 83154 - DNA, 391 bp, Zea mays
  unsure at all n locations
  Clone ID: LIB3114-046-P1-K1-H5
aaaaaaaaaaaaaaaaaaaaaaaaaaaaaaaaaaaaacaccctaaaaaaaaaaaaaaaaaattaaaaaagggttactttctcctttgtgttttattttatacctccctctccctttatttctcctccttttccctcttctctccctccttttcccatccttttccacccctctttccttctcgnannncccatttttcttccttttcttatcttcttatcttttctcctctctccccttttcccctttcttcatttttccttttttcccctttttcttcccccttttctcacctccttcataatttcgtnnnttcttccattcatttctccctcccttctttttaactcctttttctcttctctctatttaccctctcttttcctcccctc

SEQ ID NO: 83155 - DNA, 462 bp, Zea mays
  Clone ID: LIB3114-046-P1-K1-H6
cgtccagaactcccgggtcgtcccacgcgtccgaaaaaaaataaaaaaaaaaaaaaaaaaaaaaaaaaaaaaaataaaaaaaaaatattaaaggaaaaataggggaatattaaaaaggtgtctcctttttttttctttttttttatttattaataatcttgccggcccttttatatgttccaattttctttcccctttcctccacctattttatttttttttagggccccctaattttaatccctttgcctgttttttacattctcgtacttgttatacccctggttttcccatttttattccccttgaagtatattcccttttttccaattttgtttattatttaaaagccctctttttttttctcttttcctaatatttgttacctcttttttttgccatattttctcccccctcctttttcttctcttttttatacctctttctcttttttcttttctc

SEQ ID NO: 83156 - DNA, 252 bp, Zea mays
  Clone ID: LIB3114-046-P1-K1-H9
aaaaaaaaaaaaaaaaaaaaaaaaaaaaaaaaaaaaaaaaaaaaaaaaaaggaaattaagtggataaaaaattatgggcgcggtcttgggcggcccttttttgggatcctttttttcttccccttgtttgccatgcctttgcttcttctttggggccccctattttcattttactggccggcgtttttcagggctttttctggatacccctttccctttccctccttgtttgtcttccggcacttccccttt

SEQ ID NO: 83157 - DNA, 122 bp, Zea mays
  Clone ID: LIB3114-047-P1-K1-A11
aaaaaaaaaaaaaaaaaaaaaaaaaaaaaaaaaaaaaaagggagaaaaatatgggggaggggatattacgtacacgggcatgccacgtaatagctcatatatagatgttcctaattgcaacc

SEQ ID NO: 83158 - DNA, 468 bp, Zea mays
  Clone ID: LIB3114-047-P1-K1-A12
tttccctgtgtcgacccctctccgtccgaaataaaaaaaaataataaaaaaaataaaaaaaaattaaaaataaataaaaaaaaaataaataaaaataaagaaaaaattaataataaaaaaacaaaaaacaacattacaacatttcatttattaacttactattatattttttcttcttcccttcctttttttttttcttttccttcttttttttttccccctctctttcctttctttttccttttttctttcctttttttttttccctttcttttttcttttccctttttttcccctctcttctctctcttctcctttccttttctttttttccccccccttttcttttccccccctcttttctcttctctcctcccctctttctccccccttttccccccctttttttcccttttttcctattccttttcccccccttttcttttttttctttctcccctctctttt

SEQ ID NO: 83159 - DNA, 244 bp, Zea mays
  Clone ID: LIB3114-047-P1-K1-A2
cgatcgtggtgtgtgtaaggaactaaggacgacggtgcctggtttaggcgtttagctatagacgaaagcacgtacggccgcgtgcctggtctagctacgcggccggttgatcttgagcagttaagcgtgtacgaaacgacagcgctgtgtacgtgtactgtctgctgaagtgtgagatgtactgtctgtgtgtatttggtatggatccgatcggcctgatgtatgaaaaggatgtttacgtact

SEQ ID NO: 83160 - DNA, 102 bp, Zea mays
  Clone ID: LIB3114-047-P1-K1-A4
gactatgttataagatcgcgagcggccgttctagaggatccatgcttacctactcctgcatgcggggtaatagctcttttatggtgccacctaaattcaatt

SEQ ID NO: 83161 - DNA, 233 bp, Zea mays
  Clone ID: LIB3114-047-P1-K1-A5
aaaaaaataaatataaaaaaaaaaaaaaatataaaaaaaaataaaaaaaaaaaaaataaagaaaagagataattataaatatgggggggcccctttttagtttccgtgctcccttctttttccccgtctttcttcccttcctttggcttttatttttttatttggccctcttttcctttttttccttgttttatccctgtcttccccgtttctctgttttaacccattttttt

SEQ ID NO: 83162 - DNA, 294 bp, Zea mays
  Clone ID: LIB3114-047-P1-K1-A7
cacgcgtccgaaaaaaaaaaaaaaaaaaaaggacaatataaatcaagcatacgtgaaatacagagacagggggcaacataccttatattttctaccaactacaatatactagccggtcttcgtcatacaactaactgggtgggggcagccctgtgccaccaaactcgttttggggggcgcacatcttcctcctttttggcaggtggaataatagcgatgcccgggccgcccgtcattcaaaacataccggggagcatacatattggttcgcgcgctttttgctgggactgatca

SEQ ID NO: 83163 - DNA, 339 bp, Zea mays
  Clone ID: LIB3114-047-P1-K1-A8
attcctcgggcgacgcgccgcgttccccatccttatatattttaagaactaaggacaacatatcctatattacgtattcatagagagacggaagcacgtacggtcgagtgcctagtaaaactacacaaccggtcgatcttgaacaattaagcgagtacgaaacgactgccctgtgtacatttactgactgttgaagagttacatgtactgtctgcgtgtcttatagtataaaacggaccgacctaatgccttaataaacagttcacttacttaaatggggaaagtgacgcgccctgtataaaggaatcaagcctacatactcttacatgcaaccctcat

SEQ ID NO: 83164 - DNA, 260 bp, Zea mays
  Clone ID: LIB3114-047-P1-K1-A9
tttctttctgcagaagttcattgcccttactatttgatgctgggctagcgtgtacgccgcatcgtccttttgccatttccaccacccgctatatctctggtcctttttgtatctagagtcttgagtgataggttgattccgaataacagtctgggctttgagcttagccttgggtcatctcatcggtgaatgctgaatggtacaaaatactggcatacgtgtcagttttataaatcatttctgggcagcacagattcttt

SEQ ID NO: 83165 - DNA, 427 bp, Zea mays
  Clone ID: LIB3114-047-P1-K1-B1
cactaaccatcatgtgaatgggttcgacataaagcatgaggtaaagatcgccaagtacaaagcacggaaaatggcacagtttaagagggctatccatccatctcttgacttcgacaatgcatatggagtaaataggggtaagccttcactgaacaagctgcaatctttccatgttggaaagaaccacaatttccgtgtgccaacctgtgatcgaagcccgggtaaagtaagcacagactatcattctgacttgaacagccaagtattgcaaagtaggcaccccgatccgggagcccaaagggcccggcattgtgaggtcaatgcagctgggagcagcacggagtgtatgtttacagggaggcgctactacaccggagctcagctgccgccgaatctcccaagaacaaaatctgtacccctgaatgct

SEQ ID NO: 83166 - DNA, 85 bp, Zea mays
  Clone ID: LIB3114-047-P1-K1-B10
aaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 83167 - DNA, 222 bp, Zea mays
  Clone ID: LIB3114-047-P1-K1-B12
cgacttgcatgtctactactactactgaataaaaaacctctccgcgcacgtcgtccttgtgtttgtgtgtgtgagagagagaggagatggagagccggccatgtccttttggctgtttggtttatttttgagttcatgcggtctttatttatttccatgtacgctgcttcctcgtatacccactttaaatttgtaccatgcatgcatgttccttatgataaa

SEQ ID NO: 83168 - DNA, 245 bp, Zea mays
  Clone ID: LIB3114-047-P1-K1-B4
acttagccatgttggtcatattgatcatgagttacctatgttgagcttaaactatcttgtgtccaaccatcgctgggtagtatgattactgtaatgtagggtggttaaggtcgcaaactaatacttatattgcatgtgtcgaagatccattccaattgtacttctagcgcactatttgtgaaatgttgctgggcctgtacggcattgacattaggtatcacaccaaaggattaatctgttccatt

SEQ ID NO: 83169 - DNA, 103 bp, Zea mays
  Clone ID: LIB3114-047-P1-K1-B6
gactaattctagatcgcagacagccactctacaatgctccaagcttacgttctcaatacatgcgagagcataacgtctagggtgggggcacctaaattcaatt

SEQ ID NO: 83170 - DNA, 427 bp, Zea mays
  Clone ID: LIB3114-047-P1-K1-B7
cgtccggactaaccataatgtgaatgggttcgacataaagcatgaggtcaagatcgccaattgcgaagcacggaaaatggcgcagtataagatggctatccattcatctcttgacttttacaatgcatatggagtaaataggggctagccttcactgaacaagctgcaatttttccatgttggaaagaaccacaatttccgtgtgccaacctgtgatcgaagcccgggtaaagtaaacacagactatcattcttacttgaacaggcaaatattgcaaagtaggcaccccgatccgggagcccaaaaggccccgcattgtgaggtcaatgcacttgggatcaacactgaatgtatgtttacagggaggcgctactacaccggagcttaactgtcccccaatcttccaagaacaaaatttgtacccctt

SEQ ID NO: 83171 - DNA, 425 bp, Zea mays
  Clone ID: LIB3114-047-P1-K1-C1
aattggtgaaagaaatcggtcgacaggttgcaactgatcgatgcatcatggccatgctttttctcattgttgctggagtcatagctataataattgttaagattgtgaacccacacaacaaggacattcgcgacatccctggcttggcaccacccgtcagcaggcggctgttgcgatagaggacaggtgaattgcatacctggtgtaaaaattgatgtggcgcggcgccttggcaagcccatctgtattctacgtcttgtaaaacgctgctccagtcatgtggtatattgctgtaaaacttctcatgggatccactcctactccttggctacacacagtgcgtatatgttcctcctagttcgccttcctgtttttgcaaaactaactctgaacggtgttctgttagaatcatgtgcacacatgat

SEQ ID NO: 83172 - DNA, 316 bp, Zea mays
  Clone ID: LIB3114-047-P1-K1-C10
caaagggagctcagggcacgcggcttggaccccgcgctcggctgggacgtcaacgcccagaaggcggccaataataacgccggcgccggcatgacgatgtacccgccgacggcgcaggggatgggccgctaattacgctaccagctccatcggtaaactcatatgttgttgtgttgtgtcagccagatcatcgcgtacgtacgggtatacttgtgatatgtaatgtcagggaccggcatgcccatgtgtttcaagatatttcacgttcaagtcctttctgtctgctcactatccgaatgaaaaccattttccttgg

SEQ ID NO: 83173 - DNA, 423 bp, Zea mays
  Clone ID: LIB3114-047-P1-K1-C12
tttgcagtttgtataggctaattaaaattaagtcaacagagcgtaaatgaccatctctgctccactcaactcaactgtagcaaggagcatatgtttagcatagaggtttgactgaatggccctgcccaagaagcagattcagctcttgggcatggtctgtatcatcctgacattctgttggatggaactgcaattgtgcaaaaaaaaaaaaaaaaaaaaaaaaaaaaaaaaaaaaaaaaaaaaaaaaaaaaaaaaaaaaaaaaaaaaaaataaaaaaaaaaataaaacacaaaaaaaaaaggaggttacatcacataaaaaccgattacaatagacataatatatatttggggggggcctttttaaagatcccatgtttttttcccggggtttgcggggttttactttttttttggggcccca

SEQ ID NO: 83174 - DNA, 81 bp, Zea mays
  Clone ID: LIB3114-047-P1-K1-C2
ccggaattcccggggcgagccacgcgtccgaattacatcccttactccagagagacgtggacggccgtccaggcatgatcc

SEQ ID NO: 83175 - DNA, 372 bp, Zea mays
  Clone ID: LIB3114-047-P1-K1-C5
aaaaaaaaaaaaaaaaaaaaaaaaaaaaaaaaaaaaaaaaaaaaaaaaaaaaaaaaaaagaaaaaaggggaaaaaaaaaaggggggtaaaaaaacaaaaaaatataaatattaccataaaaaggggggggcccttttaaaggtcccaactttcctcccccgttcggccaactcatttgttttttttttgggtcccctaatttaatttccctgcccgcctttttccacctgtgttcttggaaaacccctggtgttccccaccttattccctttgtagcacttcccctttttcccagttggtttatatccgaatgagccccatcttacttccctccccaactttgtccccccctaattggccatttgtcccccc

SEQ ID NO: 83176 - DNA, 88 bp, Zea mays
  Clone ID: LIB3114-047-P1-K1-C8
ctgtacgcctgcagttaccagtccggaattcccgtgtcgacccactcgtccgaccacacatcctaactaaaatctagatccctaacgt

SEQ ID NO: 83177 - DNA, 165 bp, Zea mays
  Clone ID: LIB3114-047-P1-K1-D10
atttcctttccttaattcccggggggggccatcatacttactatctttagatctatatctatatctcaagcggcctctctataacatccgggctggggttcacatgcatgcggggtaatatctctcctatagttacacctataatcaattcattaaccaattttt

SEQ ID NO: 83178 - DNA, 84 bp, Zea mays
  Clone ID: LIB3114-047-P1-K1-D2
gagccaatgtttcgccacgctttgccgctgtttcaaaaaaaaaaaaaaaggggaaggggaaaaaaaggagagggggttataaaa

SEQ ID NO: 83179 - DNA, 70 bp, Zea mays
  Clone ID: LIB3114-047-P1-K1-D3
gattatcgatgtctccgtcatgtacctgaacgatgtagacgtacatatatgtaactgattaatgtgtatc

SEQ ID NO: 83180 - DNA, 406 bp, Zea mays
  Clone ID: LIB3114-047-P1-K1-D4
aaaaaaaaaaaaaaaaaaaaaaaaaaaaaaaaaaaaaaaaaaaaaaaaaaaaaaaaaagagaaaaggggaaaaaaaaaaaaaaaaaaaaaaaaaaaaaaaacaaaaaaaaaaaaaaaaaaaaaaaaaaagggggcggccgttttaagggacccagggttccccccccgggcttccaactttttcccccttttttggggccccctaatttaatttcctgggccgcctttttccaacggggggccggggaaaccccgggggttccccagttaaatcccctgggaccccccccccttttgcccgggggggtttttaccaaagggcccccgcctattcgcctttcccaccattggcccaccctttttggaaattgggcccccccctttgggggcgctttacccccggggg

SEQ ID NO: 83181 - DNA, 148 bp, Zea mays
  Clone ID: LIB3114-047-P1-K1-D5
aaaaaaaaataaaaaaaaaaaaaaaaaaaaaaaaaaaaataaaaaaaaataaaataaaaaaaaaatgtaaaataaaataatagctgtttttaaaaaaaaatattaataatttattaaaatttttattttttcagtcgttttaattttt

SEQ ID NO: 83182 - DNA, 66 bp, Zea mays
  Clone ID: LIB3114-047-P1-K1-D7
aaaaaaaaaaaaaaaaaaaaaaaaaaaaaaaaaaaaaaaaaaaaaaaaaaaaagaaaaagaaaaaa

SEQ ID NO: 83183 - DNA, 73 bp, Zea mays
  Clone ID: LIB3114-047-P1-K1-E1
aaaaaaaaaaaaaaaaaaaaaaaaaaaaaaaaaaaaaaaaaaaaaaaaaaaaaaaataaaggaaggggaaaaa

SEQ ID NO: 83184 - DNA, 186 bp, Zea mays
  Clone ID: LIB3114-047-P1-K1-E10
cagttttttttttttttttggcgttgtatagaatagaaccgacccaaaagatgcctggtgtcttgtagactaattatggggattcttcctatgcctaagctttctcttttcttctgtctcttttacagtttgctggattcgcttgtcctgaatcggtattgaactgtcgtgtgactatttacacct

SEQ ID NO: 83185 - DNA, 393 bp, Zea mays
  Clone ID: LIB3114-047-P1-K1-E11
aaaaaaaaaattaaaaaaaaaaaaaaaaaaaaaaaaaaaaaaaaacaaaaaaaaaaaaggagaaattaaaaaaaaggggggaggaattcttacctataccccaacctttctttctctttctttcacctttctcactttttttattatctctcctcctattatatctattgattctctattgtgcccccttttcacctgtcaaacctccttccccccttcccttcttattcttcttttttttttttccccctccctactttcatcctattccccctttttcccccccctttctcctttaaccccttttgcccccccctttatttcccccctgttccacccccctcttttttctccccttgtcttcttttcttttaaggtccccccccctctttc

SEQ ID NO: 83186 - DNA, 330 bp, Zea mays
  Clone ID: LIB3114-047-P1-K1-E2
aaaaaaaaaaaaaaaaaaaaaaaaaaaaaaggaaaaaaaaaataaaaaaaaacaaaataaagaacacgtaaaatgaaaaaaaataactataatataaaagaaaactaaatataatgggggtggccgttttttaacaaccatatttactggccctaccttgccactacttatcttttttttggtggcaccaaattcaattttattgggctgggtttaaaaagatgaggccgggaaaaaccttgcttttccccaatttattagcctggatggcaatccccttttgccctgttggggtaatttaaaagaggccggcgcggttggtccttccaa

SEQ ID NO: 83187 - DNA, 62 bp, Zea mays; identical to SEQ ID NO: 83042
  Clone ID: LIB3114-047-P1-K1-E3

SEQ ID NO: 83188 - DNA, 200 bp, Zea mays
  Clone ID: LIB3114-047-P1-K1-E4
ctagaactagtcaaaaaaaaaaaaaaaaaataaaaaaaaaaaaaaaaaaaaaaaaaaaaggaagagggaaaaaaaaaaagggggatggagaaaaattcctatacctaaaactttcagggcggccctttttaattttaccaatttgctggactcgtccttgccacacttttacttttttttgggggcccctattttaattt

SEQ ID NO: 83189 - DNA, 325 bp, Zea mays
  Clone ID: LIB3114-047-P1-K1-E6
aaaaaaaaaaaaaaaaaaaaaaaaaaggacaaaaaaaaaaaaaaaaaacaaactaacaagggcggggcgtataaagaaataggtggtagtatcctgacacctaaataatgattcgggggccgtcgttttgggggcgtcgtgtctggggtcccctttgcgttccccaacttttttctctttgcgccccttttaatctttcgcctggtcccattttatccgccgtggctttctcccatcccccttgggaacccctccgcattccccatggtaatcggcccgctccctgtcccggttttttaacctcgggggtctgtccggttgcccc

SEQ ID NO: 83190 - DNA, 421 bp, Zea mays
  Clone ID: LIB3114-047-P1-K1-E9
caaatggtttcccacttaggttgaaaatgatgatttgattgcctacggcctgatcccagaatttattggaaggttgccaataacagttggcctgaccaatcttagtgaagagcaattggttcaagtagtaaatttctttgattttataatttaaagcaatatttcttaaaattaccatctcaaatatttccaccacctcaaaatattagaaattctctttgcaggtgctcatggagcccaaaaacgcaataggaaagcaatacaagaagctattcaaaatgaatgatgttagtttgtgattcgtttcggccaacgaaataattgcaagatttggccgattttttttactttaaacgataatttataaccaagaaagttatttttggtcatgtttcctccataaagtcaagcttcattttac

SEQ ID NO: 83191 - DNA, 424 bp, Zea mays
  Clone ID: LIB3114-047-P1-K1-F11
aaataaaaaaaaaaaaaaaaaaaaaaaaaaaaaaaaaaaaaaaaaaaaaatacaaaaagggggaacaatttaaaaggggcaaaatacatacccatacattccttcctcttacctctcatttatccaatatcttatttttcgggcccctctttctttttccccatctttttcctccccgctctccccccctattcccttttttttttttcccccttttttctttcccttgcccccctttttccaccctctttcttgggaaaccccttccttcccccccctttttcctcttcttgaacccccccttttcccccccttttttcttattttaaaggcccctttcctttttccctttcccaccattttctccccttattttggttttgccccccccctctttcctccttttttcccccggttttttttt

SEQ ID NO: 83192 - DNA, 430 bp, Zea mays
  unsure at all n locations
  Clone ID: LIB3114-047-P1-K1-F12
cttttagtccttttttgtcacccctcaagggactagagactaaaagggtttagtcctgtgatatttggaaatttggtagtctgatgcatgcacattcgatctgtctcatcagtgacatgtatcgcttgtcatttgatgaaaatggaagttgaacgatcattctctttttgggcactgctgaaggtgatgttgttcacccaactgagtgtatgccccagctgcttgagcaagttcggcatcacaaagcgaatatcgattgcaatgattatattgtcatggtgactacattggttcttgaggttgaggatttgtctacacaacaagtgaatgataagctcctagaagctgtacaaccttaagcactcgagcaatggagcaatgtggtatgatgagagcatangaggtttgtcgagatgaggtcgaaacatgg

SEQ ID NO: 83193 - DNA, 164 bp, Zea mays
  Clone ID: LIB3114-047-P1-K1-F2
ccacatttattatggttttacacccaatatagttgcaataccattacatacccgcacaatacacctgctgctgctgctaaacacatgggacgaacacacagtagagactataaattaaacggccgggacggcagaagacagaggccgggagcacagagctctgc

SEQ ID NO: 83194 - DNA, 59 bp, Zea mays
  Clone ID: LIB3114-047-P1-K1-F4
aaaaaaaaaaaaaaaaaaaaaaaaaaaaaaaaaaaaaaaaaaaaaaaaaaaaaaaaaaa

SEQ ID NO: 83195 - DNA, 322 bp, Zea mays
  Clone ID: LIB3114-047-P1-K1-F5
atgtggccatgcgggacacccaccgccgaataaaatgctgttgagttctgaaaaaaaaaaaaaggaaaaaaaaaaaaaaaaaaaaaaaaaaaaaaaaaataaaaaaaaaaaaaataaaaaaaaattacatgaaataaaaattaatttaatataaattcaacctaaattaatttttctttgatgtagttttacaacatttctgtctgtttacattcctgaattttttccggtttttttttcctttcaatactttcttcctttgtcccgttttggccatttccattttgtctgcacccctttttcttaccattttttgcgcttt

SEQ ID NO: 83196 - DNA, 146 bp, Zea mays
  Clone ID: LIB3114-047-P1-K1-F6
cgcctgcaggtacaggtccggtattcctgggtcgacgcacgcgtccgtgtctgtcataatgatatggcatctgtagctattttggttctgtcagaatcatgttggttggagagaaaaaaaaaaaggggggggagaaaaaccaacaa

SEQ ID NO: 83197 - DNA, 407 bp, Zea mays
  Clone ID: LIB3114-047-P1-K1-F7
aaataaaaaataaaaaaaaaaaaaaaaaataaaaaaaaaaaaaaaataaaataagggactggtgaaaaataataaaggagaatataataaataccacaattcatttaacttaaaagtatatccacatcatctttactatgtacacattttttttatcaacttttaattggcgggctgccttttcatgttttcctcttttctcacgattttttccctttacatctccttttttttttttccaacattatttccttcctttgtggcgtttttttacactcctgtgtaggggaaaatttcttcgcttcccctttttttgtttttcgcaacatcaccccttttttcgggtgtgtctttattaggtagggttcctccttttttcctttttatattatttcttccttcttttt

SEQ ID NO: 83198 - DNA, 335 bp, Zea mays
  Clone ID: LIB3114-047-P1-K1-G1
gtaggacttacttgagtattggtatttgctaatggatactaatcaatctcttctaaggggaaggggaaaaaatataatatagagtaaaataaaaatataataaatggccgtaagttttacaaaggggtgggtgggttagcgctttcgtttccccgctcccttgctcttgcattacatgcccttttttcgtgttaccgtaattgaatttcagggccgtggcgatcgaccttcccatcttggcgcaccctgtctggcccatggtactctccctgcagcggggcctcctgctcctttgttgtggtggtttcgcagcggccttgccggttctcttttcc

SEQ ID NO: 83199 - DNA, 258 bp, Zea mays
  Clone ID: LIB3114-047-P1-K1-G10
aaaaaaaaaaaaaaaaaaaaaaaaaaaaaaaaaaaaaaaaaaaaaaaaaaaaaaaaaagggggaaaaaataaagggggggaaagttactatcctctttctctctctttttttgttggccggtctttttttttttcccctcttttcttccctttcctctgccttttcccttttttttttttttcccacttatttccttttcttgccccctgtttttcacccttccttttgggatatcccttggctttccccactatttt

SEQ ID NO: 83200 - DNA, 246 bp, Zea mays
  Clone ID: LIB3114-047-P1-K1-G3
aaaaaaattactaaaaaaaaagaaaaaaaataaaaagaatactaaacaatctactatatagggagaagggtaaaaggggggcgtgggctgcttatcaagcttttttcagcggctctaagcttaacttacatctcttgggggtggccccttttttgggggggggccccttttcggtcccccctttttccctgggtgttcccggggggcccccttttttttttgggggccccgctttttttccccggg

SEQ ID NO: 83201 - DNA, 413 bp, Zea mays
  Clone ID: LIB3114-047-P1-K1-G4
aaaaaaaaaaaaaaaaaaaaaaaaaaaaaaaaaaaaaaaaaaaaaaaaaaaaaaaaaaaaaaaaaggggaaaaaaaaaaaaaaggaaagaaaaaaaaaaaaaaaaaaaaaaaaaaaaaaaaaaaaaaaaggggggggccgttttaaaggaccaaagtttacttccccggccttgcaacgtaataccttttttttggggcccccaaaattaaatccccgggccggggtttaacaacgtggggacgggaaaaacccgggggtccccaaattaaatcgctttgaagaaaatccccttttccccaggggggttaaaacaaaaaaggccccccccattcccccttccaaaaattggcccaccctaatgggaaaaggggcccccccctttaccggccctttaaccccgggggtgggggg

SEQ ID NO: 83202 - DNA, 316 bp, Zea mays
  Clone ID: LIB3114-047-P1-K1-G6
cagctgtgtctgtgtcagctattgcttatggaactgatacctgtagttctattcaaaaaaaaaggaaaaaaaaaaaaaaaaaaaaaaaaaaaaaaaaaaaaaaaaaaaaaaaaaaaaaaaaaaaaaaaaaaaaaaaaaaacaaaaaaaaaaacaaaactaaaaaaacaaagcaaaacaatacaacaatcaccaaactgaaataaaaacaaaaaaagcccaaaccgaatcgccggggccaaccgtttgagcagccccaatggttaccccgtcctcgccctgcaacagctcataaaaaaggggccctaatataggtta

SEQ ID NO: 83203 - DNA, 206 bp, Zea mays
  Clone ID: LIB3114-047-P1-K1-G7
aaaaaaaaaaaaaaaaaaaaaaaaaaaaaaaaaaaaaaaaaaaaaataaaaaaggaaaaagggccacacataatagaggtcccaatcttacctactcgtccctgccccttttctccttttttatattgtaactctaaatttaattctttcgccgcctttatacaacatcctgacttgaaaaaccctttatttccctaacttaattc

SEQ ID NO: 83204 - DNA, 247 bp, Zea mays
  Clone ID: LIB3114-047-P1-K1-G8
aataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaggccgcggcggatatccggactaggccttc

SEQ ID NO: 83205 - DNA, 198 bp, Zea mays
  Clone ID: LIB3114-047-P1-K1-H1
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaagggggggcccttttaagggacccaagtttacttccgcgtgcttgcaacgtattagcttttttttagtgtcccctaaattaaatt

SEQ ID NO: 83206 - DNA, 211 bp, Zea mays
  Clone ID: LIB3114-047-P1-K1-H10
ccccccctcaattccgcctatagattcccctctttcatggattttgatccaatcgtaagattgtcagtagctctagattcgtcggtagctccagcatgagtgtcggtggtagttctgtgcctgtaaaaacttgggatagttgatcgcgtgtgatcagccgtcatgctcctccagtctctatgaacaagctaagctataatagtattttgct

SEQ ID NO: 83207 - DNA, 313 bp, Zea mays
  Clone ID: LIB3114-047-P1-K1-H3
aaaaaaaaaaaaaaaaaaaaaaacacaaaaaaaaagaaaaaaaacggaagggatatactggggaggggtcttcgatatttatgggattctaattcattttttaaattaaaaagggaccgcttttcttttttctggcctttgttttcccctcgagggcactgagttgttccctgtgtttattccaatttattggggcgtcgctctcggggctccttttttcagcagccgtgtttgtgaccaggctggctccccttgtttctcccccctgttttcccccctggttggcttttgggggcgtccttgtaaacgggcc

SEQ ID NO: 83208 - DNA, 412 bp, Zea mays
  Clone ID: LIB3114-047-P1-K1-H4
aaaaaaaaaaaaaaaaaaaaaaaaaaaaaaaaaaaaaaaaaaaaaaaaaaaaaaaaaaaaaaaaaagaagaataacgatttgggggttcctttcttccctcctctttcttgccccgccttccctcttcttttttgcttccttttcttatttttatcgcgtgtgctttttcttttttccttgctccagtttttcttgccgtccccctttttaatacccttttgctaaaaaaacctttcgccttttggctttttcgcctttcggcccgcgccgttctccctttcgtcctttcctttatggctctttcccactgtttcgcccccttgttttggcctctttacccccccccttgtatttgcccttttcccccccacttttgcctcttttactttatccccttctcctttaaccccc

SEQ ID NO: 83209 - DNA, 315 bp, Zea mays
  Clone ID: LIB3114-047-P1-K1-H6
gtccggcgttcccgggtcgacgccacgcgtccgagagtacacattttgtacacaagcgatagattgtttgatctcgtcgtatgtaactggttcagtatacattcggaccttaacctggagagtggagacagggtgttgcaactttccattgaactttcagcatatagatacagttctttctcgttttgttactatttacggtctgtaatcttgttttgaactgcctgaaccatcacgccattccaatgctgatgtcatttgcagaactcttgtaccagtttcagtttatatcattataagatcaacgcttttctg

SEQ ID NO: 83210 - DNA, 92 bp, Zea mays
  Clone ID: LIB3114-047-P1-K1-H9
cccacgcgtccgcggacgcgtggggtatgatgtaaccgtttgtgttatactggctccggtcttcgatatttatcgtatcctagttcattttt

SEQ ID NO: 83211 - DNA, 218 bp, Zea mays
  Clone ID: LIB3114-048-P1-K1-A1
gctgttcgcctgcggttccggtccggttttcccgggtcggccctcgcgtccgggttttttattttctcttgtcataaacttttttataatggtaggggggtattcattttttcggggggttcattgggggatcgtttcttcttttctctttcgggcggcccctttgggggtccttttttcgtccttgtttctcttttcttttttttttgccctttttt

SEQ ID NO: 83212 - DNA, 154 bp, Zea mays
  Clone ID: LIB3114-048-P1-K1-A2
aaaaaaaaaaaaaaaaagaaaaaaaaaataaattaacaaatccacctcaggggaaacgagcaaaagctatctgttgtataatctcaccttatttcactggccggctttttacaaccatcggcctgggagaaccatgccggtagctacccaaatt

SEQ ID NO: 83213 - DNA, 84 bp, Zea mays
  Clone ID: LIB3114-048-P1-K1-A3
aaaaaaataaaaaaaaacaataaaaaaaaataaataaaaaaaaacatatacataaacctgagcaaaaaaaataaaatgaaataa

SEQ ID NO: 83214 - DNA, 208 bp, Zea mays
  Clone ID: LIB3114-048-P1-K1-A6
caaaaaaaaaaaaaaaaaaaaaaaaaaaaaaaaaaaaaaaaaaaaaaaaaaaaaaaaaaaaggaaaaaaagagaaaaataaaaaaaaaaaaaataaaaacacctaaaataaaaaaaaataacttgggggggcccctttaggggacccaagttaccgtccccgtgtttccaactctattgcttttttttagggccccctaaatcaaatt

SEQ ID NO: 83215 - DNA, 368 bp, Zea mays
  unsure at all n locations
  Clone ID: LIB3114-048-P1-K1-A8
aaatcacgttgagaagcattgctagctcgacgcagatgcatgacctgatcaagggcacactggaaaatcagaggaatttcgtctgacatgtgcacggtgcaatcgttcacccatcctcccgtagcacatctgtgaaaatcaaggttatcttggtctatttcggtacatctagactgacctttattaaatctaatgtaatgcctaagtggactagataagtaattcgcttgatgtaaactgcccagctgtaggatccagttttaaagtcctgttccacgcacttaaaacttaggggccgtctctcgggcggcttcnaaaaataaaatagaaaaaaacataaaaaaagaataataaagaaaaattacata

SEQ ID NO: 83216 - DNA, 471 bp, Zea mays
  Clone ID: LIB3114-048-P1-K1-B1
accggtccccaattccctggtcgacgccacgcgtccggaaaaaaaaaaaaaaaaaaaaaaaaaaaaaaaaaaaaaaaaaaaaaaaaaaaaaaaaaaagggaaaaacaagggagccgcgtcaatcctaacttacatccccccttacttatcttctccatactttctttttcctttccctttattttcccctcattttccctcccctttccccccttttaccccacataacccccatctcccccaacttacccccttttacctccttttccctttctcccctttccccaatcccccttcatccccattcttcccccccttatcaccctttccaaaccctccattccctttattttcaactttttccctccccttttcccccctctaattccccttttttcttacaacttatccccttcccctccccatcctctttttcccccctttctttcccttctttcccttcctttcccc

SEQ ID NO: 83217 - DNA, 422 bp, Zea mays
  Clone ID: LIB3114-048-P1-K1-B11
ctaaaaaaaaaaaaaaaaaaaaaaaaaaaaaaaaaaaaaaaaaaaaaaaaaaaaaaaaaagggaaaaaaaaaaaaaaaaaaaaaaaaaaaaaaaaaaaaaaaaaaaaaaaaaaaaaaaaaaaaaaaaaaaaagggccgccctttttaaaaaacccaattttacttccccttctttccaaaataatacttttttttttgtgcccccaaatttaatttccctgcccctttttttacaacttttgacctgaaaaacccttggcttacccaaattaaatccctttgaaaaaaatccccttttccccagttggtttaataccaaaaaggccccccccattcccctttccaaaaattttcccaccttaatttgcaattggccccccccctttaccgcccctttaaccccccggttttttttttttccc

SEQ ID NO: 83218 - DNA, 256 bp, Zea mays
  Clone ID: LIB3114-048-P1-K1-B4
tttacgcctgcattacctgtccgtaattcccttgtcgacccactcgtccgcgccacgcgtcctaaaaaaaaaaaaaaaaaaaaaaaaaaaaaaaaataaaaaaaaatactgcgtgacaaacagaaaattataaatgtaaaaatcaataataaacaatttcttcatactctaatcctctattccttttcttttcacttggtaaaccctttctttacccaacttaatcaaaaaatattgggctcccttttttttaacc

SEQ ID NO: 83219 - DNA, 470 bp, Zea mays
  Clone ID: LIB3114-048-P1-K1-C12
gctggtacgcctgcggtaccggtccgggatggccgggggggcgccacgcgtccgacggagactgagccgggcgatcaggagtcagctgcagcagtagcacggggcgtattccgtgccaacgctgtgcagcaggatggaggtgggtgaggacttctcctcagagatgaacgatgaattctgctctttgactcaggtgggccagctatgaaacctgaaacctggactaatcgcaatgtgacatttttaggggatttcatcacatttaagcctagtttagaaactcaaatttcatccgaaattcgagtgaactgagggaaaaataaaataatttctctcaatcccctccaactcctgagtatttaagttcctaaactaatccttagggaacttaaatccttttttggaattgaaggggattaaggaaaaatataggtacctcaatgtgctttccaatttagaaggagatttga

SEQ ID NO: 83220 - DNA, 389 bp, Zea mays
  Clone ID: LIB3114-048-P1-K1-C2
gattaaaaaaatttaaaaaaactaacaatataaaaaaaaacaaaattacatacaaaaacaaagcaacaaagagaaaaaaaatataatgacaacataaattcaatacatctaaccaccttttaacaacataaaacactaaaaaaaacccattaagtggccctcctttttatatttcccatctttccccctttttcctcctcccttattttctttttttctccccccctatttacattcccctccccctcttttcccaccttttcactttaaaaccccctgtttttccccatttaattccctttgaaaacatccccctttcttcaagttcggtttaattaaaaaagccccacccctaccccttttccaaaattttcccccccttattttca

SEQ ID NO: 83221 - DNA, 426 bp, Zea mays
  Clone ID: LIB3114-048-P1-K1-C3
aaaaataaaataaaaaaataaaaacaaaaaaacaaaataaataaataaaaaataggaaaaaattaagggaaataaaaaaataacaagaaccaaataaacaaataaaaatataattaaactattttttacctttattatataactttcattatttcaataataatattttgggggcctcctttttaaaatcccccttttttcctccctttcttcccccccttttctttttttttttttcccccatttttcattttcccccccccctttttaccccctttttccttttaaacccctcctttccccccccttttttctttttcaacccctcccttttttccccttttttttttaattataaaaaccccctccctttcccctttttcaacaatttccccccctttttttttttcttcccccccccttttt

SEQ ID NO: 83222 - DNA, 152 bp, Zea mays
  Clone ID: LIB3114-048-P1-K1-C5
taccggtccggaattcccttgtcgagccacgcgtgcgggaaaaaaaaaaaaaaaaaaaaaaaaaaaggacaaacaatataaaaaaaaccaaacttacgggcacttacgggcgacgaaataaagtgttttataatatcacctaaaattcaatt

SEQ ID NO: 83223 - DNA, 229 bp, Zea mays
  Clone ID: LIB3114-048-P1-K1-C8
ggggcactgaggcgtttagggaaggacgcgcatgcacctgtgcagtgcagctgtgctaccatgaagtatttcgtgctcttgtgcgctagcttcgtttactttcgacttttcgagtaaggaataaggtgcctcttgttgcaataatgataaagctaatcctgcttgtaattacatttcgtggcatggccattccggcaacatgtccagtaaaaaaaaactttttagtttc

SEQ ID NO: 83224 - DNA, 328 bp, Zea mays
  Clone ID: LIB3114-048-P1-K1-D1
ggataaaaataaatataaaaacaaaaaaaaaaaaaaaaaacaaaaaaacaaacaaaaaacaggcatacatgggggaacttatataagagggggccaccctctttacacttccctccctcttttttcccttcccttctacctcaactctcttctatcctttcccctttttttaatcccctctccacttttttacaccctcgttactttaaaaaccttgccttacaaaactctatcctttcccaatttatccccctttcacaaaatcccctttttcccaattatcccaataccaaaaaccctttccaccattttcccttcccaaaatttt

SEQ ID NO: 83225 - DNA, 459 bp, Zea mays
  Clone ID: LIB3114-048-P1-K1-D11
tgtacgcctgagtaccttccgagtggccggggggggacgcgtccggaagaccttccatgatcttggtgggaagctggttgaggtgaagcgtgcggggccccgtgaggcgaaccctggtggctcttttattggacattctggggtgagtgggggttaccagagcaacaatggccataacaccagctctggtagctatgatggtagaagtgatggtggcaggtacgggcaggcacagcagggtagtggtgtctatcctggctatggtgctggggcatctggatatggatatggtgctaaccctgcaattggatatggaaattatggggctggaggatatggaggtgctcctgctgcttatggtggacattatggaaacccaagtgcagctggttctggttaccaaggtggacccccatgctcaaatagaggagcttggggcagtcaagctccatctgcata

SEQ ID NO: 83226 - DNA, 433 bp, Zea mays
  Clone ID: LIB3114-048-P1-K1-D3
ggataaaaaataaaataaaaaaaaaaaaaaaaaaaaaaaaacaaaccatataaaaaaaaaagggaataatcgaggacacatataaaaaaaaaaccctacatataaatacacattactctcttctctttcttcttctatttctacataccccctttttctcttatcacttcttcttattttccccccccctttttttatcccccccttttcctcccccccccctccccccttttttcttttttttttcttcccccttttttttcttctcttcccctcttttttccccttttttttttaaaaacccctctctctcccccttttttttttctctttcaacttccctcttttctccctttgttttattcccaaattccccccccccttcccccttcccctcttttcccccccctcctttttcttttctctctccccc

SEQ ID NO: 83227 - DNA, 474 bp, Zea mays
  Clone ID: LIB3114-048-P1-K1-E11
acgcctgcaggtacctttccttttttcccttttctacccacgcgtccgtttaaatatactaataaaaataaaaaaataaataaatataaaataaaaatagaaaaataacgaataataataataaaaataaaaaaaaaaaaaaaaaaaaaaaaaaaaaaaaaatattttataattttttttaatttttttttaatttttaaaatattaaatatttttttggcccccctttttttattcccctttttttctccctttcccttccccctttttttttttttttttttcccccttttttttttttttttcccccttttttccccccttcttcctttaaaccccccttctttccccctttttttcccttttcccccccccccttttttcccctttttctttttttctttaccccccccccctttttttcttttccaccttttccccctccttttttctttttttttccccccctttttt

SEQ ID NO: 83228 - DNA, 410 bp, Zea mays
  Clone ID: LIB3114-048-P1-K1-E4
ctccattaccgttccggaattcccggctcgagccacgcgtccgggaaaaaaaaaaaaaaaaaaaaaaaaaaaaaaaaaaaaaaaaaaaaaaaaaaaaaaaaaaggggaaccgggtgtataaaaggtccaagcttccctcctcatacatccaaaaattataacattttttttatctaaaccccaatattcatttccactggccgccatatttacaaccctcttaactcgaaaaacccttcccttttcccaacttaattccctttgtggaacattccccctttctcctgtattctttttaagggaaaaacccctcccctttttcccttcctaacataaccaccaatcttatttaaaaaattgcccccccccctctttttgacttttacccccccttttttttttccctaccc

SEQ ID NO: 83229 - DNA, 173 bp, Zea mays
  Clone ID: LIB3114-048-P1-K1-E9
gcctgcggtaccggtccgggattcccgtgtcgagcctcgcgtccgactatacatcctaccttaaaaaaaaatccaaaaaaaaaaaacaaaaaaaatggaaaaaaaagagacactttattaagggggacttacctcctttctagtggcctccctctttacttcccccttgcctg

SEQ ID NO: 83230 - DNA, 242 bp, Zea mays
  Clone ID: LIB3114-048-P1-K1-F2
cccacgcaggaagccagggagcggacaccctccataggtagccaaggataaacgtccggtgacgctccagccactggactctgctggtacctagctagtcttgctgagttgttcctgtaatgagtagaaagaatcagaacggtttggtcccgtccacgcccacgtcactttgttagctacgtagtagtataataaggtagtcttttagatgatgatgaaataaagatccagaatgttctgtc

SEQ ID NO: 83231 - DNA, 399 bp, Zea mays
  Clone ID: LIB3114-048-P1-K1-F6
aaaaaaaaaaaaaaaagggcaaacaatataaaaaaatccaagcttacatacacgtatcctgggacaccatcgctttcatataacgtcacctatattcaattcactgacctaaattcaacaacctggccactggtaacaccctggcgtaccccaacttacttgccttgacccacattcatctttttgcagcatcatgcaattttcaccaggtcccctcctaatcgaccttgccaacacctacccaccttccatacctaatggcaccctccctgtagaatggcactaaccccggagggtgtcattattccccgcagctgtaccgctacccttcgacaggacctatccacttgtcatttccctatctccccttcctttctctccacttccttcctttttccc

SEQ ID NO: 83232 - DNA, 115 bp, Zea mays
  Clone ID: LIB3114-048-P1-K1-F9
gattctgaaatgggcgaatgtggacgtagcccctgtagacgggcgcatttaagcgcgggggggtggtggattgttaacgcgcagggtggaccggctacactttgccaggggccct

SEQ ID NO: 83233 - DNA, 421 bp, Zea mays
  Clone ID: LIB3114-048-P1-K1-G1
ggaaggacgcccacgcgtccgtgtacaccatccggcaagggaaactgctgacgccaaagcagaaggcagacccagagaaattcgcggactgcatccattggtgccttcccggcgtgccggacgtgtggaaccaaatactctacacgaggattctttcaaaatcaccatggcgttctaattttagtccccctccgtcccagtccacacctcttcctccccaatgattggagaatgtaggattatcctttttgttttactttttaggttagattgagtataggttagcggagaaaggaaaatggatgtgctgattactgatggtatgtaagaaggttcagctgaagtgtaagttagttgtgagtcagccaattcaggaaacaacagcgatctagtacaaggtgcaccatggatatgatactat

SEQ ID NO: 83234 - DNA, 88 bp, Zea mays
  Clone ID: LIB3114-048-P1-K1-G3
aaaaaaaaaaaaaaaaaaaaaaaaaaaaaaaaaaaaaaaaaaaaaaaaaaaaaaaaaaaaaaggaaaaaaaaaaaaaaaaaaaaaaaa

SEQ ID NO: 83235 - DNA, 267 bp, Zea mays
  Clone ID: LIB3114-048-P1-K1-H1
cccacgcgtccgaaaaaaaaaaaaaaaaaaaaaaaaaaaaataaaaaaaaaaaaaaaaaaaggaaaaaagagaggaattataaaaaggggaaaaagggccccccccttttttaatccccattttttctcgccccctttttccacctctcttcttttttttcgcgccctctatttttttttctcttgcccgttttttcccccctttttttttttgaaaccctttgttttcccccctctttctcctttttcaccttttccccttccccc

SEQ ID NO: 83236 - DNA, 174 bp, Zea mays
  Clone ID: LIB3114-048-P1-K1-H12
aaaaaaaaaaaaaaaaaaaaaaaaaaaaaaaaaaaaaaaaaaaaaaaaagggaaaaaaaggagaaaaaaaaaaaaaagaggaaaagcaagccatggggggagccgctccgtccggtcccccgtccaagtctgatgtctttccacgcgcagcacgtttgatgaataaataaataa

SEQ ID NO: 83237 - DNA, 196 bp, Zea mays
  Clone ID: LIB3114-048-P1-K1-H2
attcactcgtgcggcctcgctttagaactatagcgtctccctcccactgaaccaagttatacttacacttgcatccaacttcggagcttttatattgtgtaacctaaattcaattcacttttcttcttttttcaacgtctttactcccataaccttcatttttcccaaactaatctcattcaatcatattcctatt

SEQ ID NO: 83238 - DNA, 86 bp, Zea mays
  Clone ID: LIB3114-048-P1-K1-H7
aaaaaacacaataaaaacaaaaaaaaaaaaaaaaaaaaaaaaaaaaaaaaaataactagtggggggatacataatgaaacaaaacc

SEQ ID NO: 83239 - DNA, 312 bp, Zea mays
  Clone ID: LIB3114-048-P1-K1-H8
agcacggcgagggccacgaccacgacggcggccacagtagcagcagcagcgacagcgactgagatctggtgtcgcagcacaggtgcaacacatgtatgcttgctggatggaggattcataccagctgatgctgatgtagtgtttcactggtgtcatgcatgtatcgtgctattataatcaaaaagaaaaaagaaataacagtcagggatggtttgtttgccatgtgatcttgtacactcctacttaaattatggctgctgcacggtgctgctagcttgtactaataaagtgttgatctgcatgcttgcgtct

SEQ ID NO: 83240 - DNA, 197 bp, Zea mays
  Clone ID: LIB3114-048-P1-K1-H9
aactaaaaataaaaaaaaaaaaaaaaaaaaaaaaaaaaaacaaaaaaacaaacacaaaaagagcaaaaaaaaaaaaaaaaaaataaaaacaaaataaaaacaaaaaaataaaagggggggccgctttaaaggatccaagttaacctccccttgcttgcaacgtaataccttttttatagggtccccaaaattaaatc

SEQ ID NO: 83241 - DNA, 108 bp, Zea mays
  Clone ID: LIB3114-055-P1-K1-A1
tgatgaggggatcagcaagtattatggtctggtcccttcctctctgtgtcaccgaccccttcgctgtaactctgctttgctgtcatgtcaaataaagcttcttgtttg

SEQ ID NO: 83242 - DNA, 163 bp, Zea mays
  Clone ID: LIB3114-055-P1-K1-A3
ctctactgtgtgttcgtcccatgtgtttagcagcagcagcaggtgtattgtgcgggtatgtaatggtattgcaactatattgggtgtaaaaccataataaatgtggaaaaaatgcaaggaaaaaaggcttctactgtttacacttaaaaaaaaaaatttattt

SEQ ID NO: 83243 - DNA, 390 bp, Zea mays
  Clone ID: LIB3114-055-P1-K1-B1
ctttcttctcctgataattaaaaacgccataaggaatccccagctggttttctgagtctgggacaaggatgggctctatttcaaccccccatccttgctgatatttccatgacaatttcatggttccaacatgatctttaggtattcctagcatgtttccttgccgcatggtttgtagcggcatggcatgcatgaagtagcgttctgtctctagggatccctaaaggcttgggagaggagacgggttttatgctctcctctgctctcttctttagttgtggttttatgttttgtccacgtatactgcgttgtactagtactatggtacaatgagcgtcaatgtgttcctatgtttatgcgccttgcatttggaatatatacgtcgtattt

SEQ ID NO: 83244 - DNA, 62 bp, Zea mays
  Clone ID: LIB3114-055-P1-K1-B11
aaaaaaaaaaaaaaaaaaaaaaaaaaaaaaaaaaaaaaaaaaaataaaaaacgatatagggg

SEQ ID NO: 83245 - DNA, 247 bp, Zea mays
  Clone ID: LIB3114-055-P1-K1-B2
cgcagggcgtgcccgccgagtgcaagctccggtgagggagcgaggtttgttgggacgtccgtggggcatcaaaaccaagcacgatccctagtcgtggaaagtagaaaccaggcatcgattcgatcgtcgtcgacggtcttagtagtagctacttattttgcagtgggcgatgaaagaatggtgtcatgtaaatgtagctccagtcgtgtcgcattctttgatttgttgtttcagcagcaccggatgt

SEQ ID NO: 83246 - DNA, 57 bp, Zea mays
  Clone ID: LIB3114-055-P1-K1-B5
aaaaaaaaaaaaacataaaaaaacataaaaaaaaaaataaaataaaaaataaaaaaa

SEQ ID NO: 83247 - DNA, 247 bp, Zea mays
  Clone ID: LIB3114-055-P1-K1-B8
ggatttttcgaacaaaaaaaaaaatatataaataaaaataaaaaaaaaaaaaaaaaaaagaaaaaataaaaagaggggggtaaataaataaaaaataaaaaatactaaaataaaatattataactaataaataatatatttaaatttaaatctcaaaataaattaattatatctttaatattattggggtttcttttattaatacttctatgttctttttcctttatttactgtgattataattttt

SEQ ID NO: 83248 - DNA, 397 bp, Zea mays
  Clone ID: LIB3114-055-P1-K1-B9
tttttaataaaaataatatatataatataaaattaatataataataataaaataaattaaaaagggaaaataaaaaaaatggggtgcgtaaattaattttttaatgttattttcttgtttttttttttttttttttttttttttttttctcttttttttttttttgttttttttttttttggttttttatttctttttctttttctctttttttttttttgcttttttttttttttttttttttttttttactttttttcttttccttttttgtcttttcttttttttttttgttttttctttgtttttttttttttttgtgtgttctttttctctcattccctacccccgccattgctcttttcttctttttttttttttttttttgtcttttttt

SEQ ID NO: 83249 - DNA, 448 bp, Zea mays
  Clone ID: LIB3114-055-P1-K1-C10
agttcagacggcaaaaaaaaaaaaaaaaaaaaaaaaaaaaaaaaaaaaaaaaaaaaaaaaaaaaaaaaaaaaaaaaaaaaaaaaaaaaaaataaaaaaaaaaagccccatataataaaaaaaaataaaaaaataaaaaataaaaaaaaaaaaaaagggggcgccctttttaaagatcccaattttcctcccccttcctttcaatatattatcttttttttggggccccctaaatttattttactgcccctttttttacacctccttttttggaaaaccctttgttttcccaaatttaaccccctttgacaccttccccttttccccacttgtgttttaactaaaaagccccccccctttccccttttcaaaaattgccccacccttatgtggaattggaccccccctttattttgccatttaaccccggggggtttgttttttcctcc

SEQ ID NO: 83250 - DNA, 396 bp, Zea mays
  Clone ID: LIB3114-055-P1-K1-C12
gacgaatactatgatgagcccgaggaatatgctcctccccctggccgcggacgtggcagagggagaaggggcggcatgccttggcgtgggcgtggaggccgcgggccaccgcgcggtggccgagggagctactactaggcgcgagaaatgcgacgtgccgaatgcgtgtgcttattagttatctgttagcgtttgctgcagtgctcttctatggagctccgaccccggactggaattatctcgtaggcccttccaggtgctactctacttcaggtgtatgtatataccacatcttcctgtcaagcttcgtggcgcgaggtgctgctgatatctaagagagtgaagctactgtactgtgctactagctagctagcgctggagatggatgagtacagt

SEQ ID NO: 83251 - DNA, 243 bp, Zea mays
  Clone ID: LIB3114-055-P1-K1-C2
aaataaaaacaaataatagatcaaacgctaaaaaaaaaaaaaagataaagattacgtgcgatgagaagtcaacataatagaggttgcgataaagaaagtggggtgcctttttaggggacctaaatttacatcggcgggcatgcgacaacctatgaccttacataatgtgtactgaatttcaatcccatgtcctttggtttaaaacgtattaactggaaaatcccgggctttaccaaacttaat

SEQ ID NO: 83252 - DNA, 381 bp, Zea mays
  Clone ID: LIB3114-055-P1-K1-C3
gcagcaagctaggatcatcagcatctgagcttattattactaaatcgatcggttgccatggcggggatgagagtcggcaagctggcgctggctgcggtgctgctgtgcgcggcggcggccatggccacggcgcagcaggcctccggcgtgcgcgccacctacaacttctacaacccgcagcagaacaactgggacctcaacgccgtgagcgcgtactgcgcgacgtgggacgccagcaagccgctgtcgtggcgcatgaagtacggctggacggccttctgcgggcccgccggccccaccggtcaggccgcgtgcgggcagtgtctcctggtgaccaacacggcgacggtggcgttcatcacggtgaggatcgtggaccat

SEQ ID NO: 83253 - DNA, 292 bp, Zea mays
  Clone ID: LIB3114-055-P1-K1-C4
acgccccggatgtctgcgaggtggtaccagggcttcctcacggcccgcaccagccagcgcgacgaagcatcgcaggcacggagagcagactcgtgatgaaccactcccatttccaccgatatatatcatcgaacgcattgctagacagccgagggtctcataactcgtgctcatttccgtcctcgccatatattggaataactgtggctgtggtgtcctaatgtctgtatatgcatatatatcatatatgttgacctcaaaagaggtttagatcaaaaaaaaaaaaaaagac

SEQ ID NO: 83254 - DNA, 392 bp, Zea mays
  Clone ID: LIB3114-055-P1-K1-C9
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggggccctttttaaggaaccaaggttaccttcccctgcattccaacataaaattttttttttggggcccctaaatttaaatcaccggcccgggttttaaaaacttcggacttggaaaacccttggtttacccaaattaaatcgctttgaaaaaaatccccttttccccggtggcctaaaaagcaaaaggcccccaccctttgccctttccaaaaatttgccaaccctaattggaaaagggaaccccccttttacgggcccttaaaccccgggggggggggggttaccc

SEQ ID NO: 83255 - DNA, 262 bp, Zea mays
  Clone ID: LIB3114-055-P1-K1-D10
ctccataggagggctgtcaacttcccgttgtgcatagtttttgttcttttgccgtttgtgttttgtccaagagcccgcaaatgcgggcgcggcttgtagattgagcgccccaggcggtggtagacactctgccgtctgcgacaaggaccccgtggtagggtatgtatagagttgcccatcatcgggagaagtgattcagtgtgtagcaactgatcgtcaaaaaaaaaaaaaaaaatatattaaaaaaaataaaatttttaaa

SEQ ID NO: 83256 - DNA, 85 bp, Zea mays
  Clone ID: LIB3114-055-P1-K1-D2
aaataaactatggaactaaggcattgtttgtttctctccattctccatgattatataatccagcttatagattatataagcacct

SEQ ID NO: 83257 - DNA, 438 bp, Zea mays
  Clone ID: LIB3114-055-P1-K1-D7
aattgttgtaggctggccagcagcttcgtctatattgagaacattcgatgtatgataggcgtgactcttttgtactgtatttcttaggctgttggttaatattattaggacaatattgagggagcggtgaaagtcaactgtctgtatttccaactgattattctgctgttcgatactcaactcccgactcccgttcacttggcaggacaatggcatatctgatatttctatcgttgaattacctttaaaaaaaaaaaaaataaattaaaaaaaaataattaaaaaaataaaaataaaaaaattaaaaaaaattaaataatattaaaataatatatataaatataaaaattaattataaataaataaaataaatatggggggggccttttaagaggttcaaatttttttcccccgtttttgcaagtttatatttttttt

SEQ ID NO: 83258 - DNA, 440 bp, Zea mays
  Clone ID: LIB3114-055-P1-K1-D8
aacaaggcgcggtgcggcatggccggggccagcgcctgcgccgacccgggcaactacctcatctgggacggcatccacctcaccgaggcggcctaccgctccattgccgacggctggctcaagggcccctactgcagccctcccatccagcactgatcgagctagctgggccgggggactgaatagctaattaagctagcagcatattattcatgagtgacatcatcgtgctttgtttgtttacggctaattgccatgtgcatcatcctagcgctctagcaggttcatcaatgatgggtttgctatttggtttgtcaattagttgttcaattggtgaggaaggggtagctggtgtttcggcggtgtggtgggaacagcgatgaataaacgtgtaatggactgtttacaattagctacgacgtacgtgaacaataagctca

SEQ ID NO: 83259 - DNA, 318 bp, Zea mays
  Clone ID: LIB3114-055-P1-K1-D9
ggtcgacccacgcgtactgaacaaggctcggtgcggcttggcctttgccagctcctgcaccgacccgtgcgggtactttatttgggacggggtgcaccttaccgatgcggtctaccgttccattgccgacggctggctcaagggcccttactgtagacctcccattacagcactgatcgtgctagttgggtcgtgggactgaatagctaattaagcttgctttatattattcatgattggcatcttatatctttgtttggttacggctaattgccatgtgcttcattcttgcgttctagtaggttcatcattgatggg

SEQ ID NO: 83260 - DNA, 303 bp, Zea mays
  Clone ID: LIB3114-055-P1-K1-E10
aaaaaaaaaaaaaaaaaaaaaaaaaaaaaaaaaaaaaaaaaaaaaaaaaaaaaaaaaaaaaaaaaaaaaaggaagggcgttttaaaaaaataaaaaattacaaacacaaacatacataaaaaaaaaattggggggggcctttttagaggttcaattttctggcccccgttttcccccctctataactttttttatccgtgccctaacccaatttaatcggccggcagtttaaccacctttttgccgggaaaacccttggcgaacccgccttaaccgtttggccttcctcccctttttcccctt

SEQ ID NO: 83261 - DNA, 352 bp, Zea mays
  Clone ID: LIB3114-055-P1-K1-E11
aaagaagaaggaaaagtggcagtgctgttgcgtggagtgtaacatagcaggttttgtaataattggttcagtcacaaacacgccaaaggaaacattccgaaactattgggatctgtgaaactgttgttgtgggaagaagactagcagctgggtcgtgtgatgaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagggggcggccgttttagaggatccaagtttacttacgcgtgcttgcgacgtaaaagtttttttatagggccacctaaattaaatt

SEQ ID NO: 83262 - DNA, 123 bp, Zea mays
  Clone ID: LIB3114-055-P1-K1-E2
aactaaatatagaatcgatagcgatcactatataagaaaccaagcttacatacacatgacgtgcagattaatgggcggtcgtatttagggatccaagttcacttacccgtgcatgcgattaca

SEQ ID NO: 83263 - DNA, 58 bp, Zea mays
  Clone ID: LIB3114-055-P1-K1-E3
aaaaaaaaataataaatatttaataaaaacaaaaaaaatctatacatacaaattaaaa

SEQ ID NO: 83264 - DNA, 294 bp, Zea mays
  Clone ID: LIB3114-055-P1-K1-E4
aaaaaaaaaaaaattaaaaaatataaaaaaataaaaaaataaaaaaaaaaaaaaaaaaaaaaaatgggaaaaaaaaaaaaggaggaaaaaaaaaataaaataaaaaataaaaaaaaaaaaaaaaaaaaggggggggccgttttaaagtaccaatgtttacttccccttgtttgcaattaaaaatttttttttttgggtccccaaaaataaatttattggccttcttttaacaacattggaattggaaaaaccctggttttaccaaattataatcctttgaaaaaaatccccttt

SEQ ID NO: 83265 - DNA, 286 bp, Zea mays
  Clone ID: LIB3114-055-P1-K1-E5
aaaaaaaaatataaatataatataaatacaaaaaaaaaaaaaaaaaaaaaaaaaaaaaataaaaatggtaaaaatcaaccattggtgtgattcctaaacttattcacttattccttacatattattattttcgttggtcgtcttatatattcccaaacttccttgtccctccttttacatctttttcacttttttatccctccaatttcccatttctctagcctggttatactttcattgttcgtcttcctttccctattcctaaaaggttttcacccttcgttct

SEQ ID NO: 83266 - DNA, 213 bp, Zea mays
  Clone ID: LIB3114-055-P1-K1-E6
gacgagtaattgtactatgttgttttgtgttttcattctcctgatgtacggtacaccttaatacggagtataataaagcacagtggtactagggatgcaaagccattttgtgtcaccaaaatataaaatatattaataaaaaaaaaaaaaaaaaataaaaaaataaaaaaaaaaaaataataataaaaaattaaaaaaataataattattttt

SEQ ID NO: 83267 - DNA, 83 bp, Zea mays
  Clone ID: LIB3114-055-P1-K1-E8
aaaaaaaaaaaaaaaaaaaaaaaaaaaaaaaaaaaaaaaaaaaaaaaaaaaaagggacgggttaaaatataaaatgcgggggg

SEQ ID NO: 83268 - DNA, 400 bp, Zea mays
  unsure at all n locations
  Clone ID: LIB3114-055-P1-K1-E9
aggcacgcctgaccaagtgcaagtaccttgctggagacttcctcagcctcgccgacctgaaccatgtgtctgtcactctctgcctgttcgctacgccctacgcatctgtgctcgacgcctacccgcatgtgaaggcctggtggtctggtctgatggagaggccgtctgtccagaaggtcgctgccctgatgaagccatctgcttgaaacggttgccctgtcaatcggtgaatggaataagccaagtctgttctgggttgtttgcttgttcagtgatgtgtcttctatgacgaaagttgagtgcctatgtgtgagcatgcttgcttgtaacgagacattgaattgttcggaaatgagcattcctgtgctcttcttgaaaataaactntgcgttaggttcaa

SEQ ID NO: 83269 - DNA, 425 bp, Zea mays
  Clone ID: LIB3114-055-P1-K1-F1
agaaccctctgcagctttccctttgactgaagtgcagcccggcacaccggttgcttgtggaagaatgctttttttattattattgtagttaagagtccagacgtcgctcaaagatgatgaacccagcccacacaagaactaaaaaaaagcaagaaaaagaaaaaaaaatagaagaaaaaccgacaaggtctacaaaagggacaaagcgccagaagaaactagagaaggcaccgggcacacctgggcgtaaaatatgtaagggggggcggctccatccagtggcaaccattttagactgcggaatccagtggacgacgaatgttgggctgatactagatagaatgcgggcgatgatgttataaggcgagggcaaggggaccccgatgggtgaccgaaataaagaagcgttctataaacttcctttt

SEQ ID NO: 83270 - DNA, 406 bp, Zea mays
  Clone ID: LIB3114-055-P1-K1-F11
aaataaaaaataataaaaaaaaaaaaaaaaaaaaaaaaaaaaaaaaaaaggacccaccggtgtaaaaaaaccaagcttacgaacacataccttgcgacgtcctacctcttctttcgtgtctcctcatcccgtttttcctgtcccttgttcttccccttcttgacttggacacccctggcgttccccatcttattcgccttgcagcccgtccccctttcgccttttggcgttttaaccaattggcccggccggctcgcctttcctaccagcctcgcagcctgactggcgattgggactctctctggctctggcccttaagctcggttgctgtgggggtttcccccaaccgtggctcctttcacttgccagcgctcctatgccccctcctttggctgtctttcctttc

SEQ ID NO: 83271 - DNA, 319 bp, Zea mays
  Clone ID: LIB3114-055-P1-K1-F2
tacaattggtaccaaaaaaaatatgtctagatgagaaaaccaaaacacaaaaaaaaaagaagaaaaatgctcgttcgttttatgtatactaaaagcatacgcccgacttcaagcaaaaataaaaaggggtgtctggttgtaaggtatactaaatttcattggcctgcgtgtaacatcgtcgttcctggataaggtcccggagttaccaaacctggtcgccttgctaaaaattcccttttgggcagatcccggtatttcccaaagttcctgtccgttcgccctttccaccatttgcccagtcggaatgtagaatggggcc

SEQ ID NO: 83272 - DNA, 218 bp, Zea mays
  Clone ID: LIB3114-055-P1-K1-F3
atcatatctggctgtgaactgcaagcaggcctagtacgccgcctgcgcgttcctcctattacacatataggcccctccctgcgtgtatgcttgataccgtcgtgtcgaaccttgtactacgaggctccatcgaacatcgatggcttgcttctttatcagaacatgtttgaatatacgctatttgacatataaaaaacaatatttggtttaaatataat

SEQ ID NO: 83273 - DNA, 425 bp, Zea mays
  Clone ID: LIB3114-055-P1-K1-G10
aacaaaaaaaaaaaaaaaaggaaaaaataaaaaaaaaaaagacaaataaaaaaaaaaaaaaaaaaaaaggaaaaggtaaaaaaaaaaaatcactaaaattaaaaaggaaaaaaaaaaaaaaaattaggaattaaaaaaaaaaaaaaaaaaaaaggggaaattaaaaaaaaaaaaaaaaaaaaaattaaaaaaaaaaaaaccaaaaattaggaaaaaaaaaggaaaaaaaggcaaaaattaggaaaaaaaaaaaaaaaccaggggacccaaaaaaaaaaagggttaaaaaggaaaaaaaaaaaaaagggggggcccgtttaaggggaccaaagttaacttcccgggccttgcaagtaaaaacttttttattggggcccccaaaataaatttccgggccggggttttaaaaaggtggggatgggaaa

SEQ ID NO: 83274 - DNA, 113 bp, Zea mays
  Clone ID: LIB3114-055-P1-K1-G2
cccacgcgttcgaaaataaaaaaaatgtgttgtaaattgttatggaagtcatataaactgggtgaaggaattataattaaaattaagatatttgatatatagtaatttaaatt

SEQ ID NO: 83275 - DNA, 71 bp, Zea mays
  Clone ID: LIB3114-055-P1-K1-G3
aaaaaaattatgtttaaaataaaataataaaaataataaaaataaaataaaaaaattaagaaaagggtaat

SEQ ID NO: 83276 - DNA, 377 bp, Zea mays
  Clone ID: LIB3114-055-P1-K1-G4
aaaaaaaaaaaaattaaaaaaaaaaaaaaaaaaaaaaaaaaaaaaaaaaaaaaaaaaaaaaaaaaggggaaaaaaataaaaaggtgtgttccatatttaaaaataaaataattaataagggcggccctttttaatggatccaatttattttacccttccttccactatttataatctttttattgttacacctaatatcaatttactgcccttttttataaaatatatataatttttaaaacctttctgtaacttatataaatctttttttaaataaaattcctcttttacccagctgtttaattaacataaaaggccccctacatatcttcttcccaaccattttttaaacttaaatggaaatatggtcccctcct

SEQ ID NO: 83277 - DNA, 201 bp, Zea mays
  Clone ID: LIB3114-055-P1-K1-G9
aactagatatagaatcgaaagcggtcaacctaaaaaaaaatacaattaaaaaaacaacgcagggctaatgtatatcccctggaagttacaaaaaacttatcaccgagggagagagagagagagaaaatcctccaagaggggagggtactaaagaagtaagtcgatggcctaacgcacacacgccgtgtgatcctggtcttg

SEQ ID NO: 83278 - DNA, 255 bp, Zea mays
  Clone ID: LIB3114-055-P1-K1-H1
gactagatctagatcgaaagcgatcgacctagataataaaacgtatttaaaaaggaccggagccaatgtatgtgccaggttggccttagcctgtaacccgctggtcaaagtgcagataatcgcgcctgaatttgcggccccctggtgggcttgggtgggttggagtcaccaccaaggggttggcacccttggtctgtactcccaataatataaaggggggggaatgtggtttccaaaaataaaaaaaattatttt

SEQ ID NO: 83279 - DNA, 332 bp, Zea mays
  Clone ID: LIB3114-055-P1-K1-H12
aacttttggtgcaaactctggtttcatcagtaactccaatgggaggcaaatgggttcatacttcaatggaagttcgaatagattgagtagttctattgggtatcttggttatgactcaagatcgatgttgagttccatgtctaggaattttaatgcaggtgtaaactacccgatcaatcctacaaacatgagtgcttttgctgcccttggaaatgggggtggcgtcaattatatgggtctcccttctattgcccctgagttggcccagttgggcaacatttcaagccttgggtcaaggaactttagccgtggagctggagttaataacttaa

SEQ ID NO: 83280 - DNA, 226 bp, Zea mays
  Clone ID: LIB3114-055-P1-K1-H3
aaatcattcattatcccaattattgctattgcgtttagtatcttccttagcttcaggcttgctgccatgtatggtgttgtggtggctgctcttggaatgctgagtaccattgccacagaccttgctattgatgcctatggccctatcagtgataatgctggaagcttaagtctgtatgggtgctatctatcatttatatgtatatctgaaagcttaagtatttttt

SEQ ID NO: 83281 - DNA, 63 bp, Zea mays
  Clone ID: LIB3114-055-P1-K1-H5
aataataaatttataataattcttttatcgttataaattaatagaatataaaaattttagggg

SEQ ID NO: 83282 - DNA, 341 bp, Zea mays
  Clone ID: LIB3114-056-P1-K1-A10
ttaaaaaaaaaaaaaataaaaaaaaaaaaaaaaaaaaaaaataaggataaaaaaaaaaaaaaaaaataaaataaaaaaaaaaaaaaaaattataaaaaaaatattaaaaaatatataaaaaaaaaaaaatttttaaaaaaaggggggggctcttaaaagtaaattaattattattatgtggattaaaatttaataaatattttatatatgtttaataaatataaaataattttggtttttttttaaaaaatatagtaggtggaaaaaatctagcgtatcaaaaaaaaataatattataaaaaaatattaatattattaaaattatttatatatataataaa

SEQ ID NO: 83283 - DNA, 143 bp, Zea mays
  Clone ID: LIB3114-056-P1-K1-A11
cggacgcgtgggaaagactaattcgttttgtgatgacaaaaaaaaaaaaaaaaatgaaagaaaaaatataatatatataaaaaaataaaaataataaaataataaatataaaataaatatatattaataaaattatataataa

SEQ ID NO: 83284 - DNA, 53 bp, Zea mays
  Clone ID: LIB3114-056-P1-K1-A12
aaaaaaaaataaaataaaaaaaaaaaaaaaaaaaaaaaaaaaaaaaaaaaaga

SEQ ID NO: 83285 - DNA, 289 bp, Zea mays
  Clone ID: LIB3114-056-P1-K1-A2
gctgggcataggcaagacacacacgcttcaccttgttgactagcggcggattgggagtagaattttgctggtgaaatcattccacgaacgaccaattattcactcatgccaaaaaagaaaaaaaaaagaagcatctttttgggtgatcttggtgtgcaacaaactgtacaatagtttgatgactaacgttaatcccagcaggttggcagtgcagagcacacacatatagatttagatattagcccataattttgtacttgctctggaatattcttgtgtttactctcct

SEQ ID NO: 83286 - DNA, 155 bp, Zea mays
  Clone ID: LIB3114-056-P1-K1-A3
taaaaaaaaaaaaaaaaaaaaaaaaaaaaaaaaaaaaataaaaaaaaaaaaaaaaaaaattaaattatgtgagtaataaaaaagatgaagaaaaatattttcataactttatatttatttattatattatataattattatatattatgaacttt

SEQ ID NO: 83287 - DNA, 357 bp, Zea mays
  Clone ID: LIB3114-056-P1-K1-A8
taatttaaatatttttataatataaaataaataaaaaaaataaaaaaaaaaaataaaaaaataaaaaaatattaaatatattttattttattttttttattttcttattcattattttatttttttcttcttatttcattttctattttttttttcatttctcttttattttcttttttttttttttttttttttttcttcttattttcctattattttttttatttttttttttttttttttttttcatttttttcttcttttttttttttttttttattttttcttattctttttaactttattttttttttttttttttcttaacttttcttccctttttattattttttttta

SEQ ID NO: 83288 - DNA, 126 bp, Zea mays
  Clone ID: LIB3114-056-P1-K1-A9
ttaaaaaatgatatttttattatataaatataattttaaataaaatataaaaaaaaagcaaaggagaaggttggtcgatagagtggttttataggggtcggccgtcttctgtttcgaccctttctt

SEQ ID NO: 83289 - DNA, 100 bp, Zea mays
  Clone ID: LIB3114-056-P1-K1-B5
taccggtcccgaattcccgggtcgaccgagcgttctataaaaaaaaatttatatgtatatcaagaggataataataaaaaaaataaaagataatatatat

SEQ ID NO: 83290 - DNA, 174 bp, Zea mays
  Clone ID: LIB3114-056-P1-K1-B6
acttgttatcttgttcgcttctgctaccgtgttcaccctagtctagagggggtttatcttccggtgtggacgactcgtgtcctatatgtttacctaaatgtacatcgctggcggtgcccatatgtggtcttgaccggaagaaccctcctgtgacgtaattagtgatgcttacaa

SEQ ID NO: 83291 - DNA, 352 bp, Zea mays
  Clone ID: LIB3114-056-P1-K1-B7
cccacgcgttcgtccccgccccttttttattttttttttgttttttttttttggggggggtgttttttatttttttttttgttttttttaaatttaaaaaacaaaaccaccttttgaatatattgtattaagggggataatgaaagaaaaaacacagtattttattcatagaccgggtgcgaataggttcccttgattggaacaggagttggcgtttattttttccaaaaaatggggcccccgtgtgggatattggcgcttttgaaagcattaacctttggagggggttggttaaaacaaaaaaaggggttggtgtctggggtggtcaattgtttagggttaggggggtccc

SEQ ID NO: 83292 - DNA, 373 bp, Zea mays
  Clone ID: LIB3114-056-P1-K1-C10
gagcttctgtcagtcatggcctgcagcgaggtatttgatagcagcaagggaggcgccgagaagatgtgccgtgaaatgggggttcctttccttggcaaggtgcccatggatccgcagctgtgcaaggcggctgaggaagggaggtcatgcttcagtgatcagaaatgcggtgccagtgcgccggctcttcagagcattgtaaagaagctgatcaagactgggtgagaaaataatgttggcctgctgggaatctggtagtgagaattgagatgaacaggtgtcagagttgtcatgaccaatatatatgttattgtgttttgaacactgaatctgtgtattagactattagtgccagtactagtattggatctgt

SEQ ID NO: 83293 - DNA, 360 bp, Zea mays
  Clone ID: LIB3114-056-P1-K1-C11
cagaagcaatagtccttcagaagcaatgacggcgatcaaagagcagcagcagcgcgaatggaaaatcgctagttaccctacatatatcaatttgggtcgggggtcgctccccattagaacagctggctaatttcatgatcacagtgaagaactgatgatatatgacagggcgctgtcacagtattttgctttttccaatccaacaacaaaaaaaagaggaacttggctacaacctaatcaatgatatttcaaccttcgggttcgtcggtcatgctgtgaagacccactccgctagctagatacctacgtccaccacttgtgaagaccgaacccgtaaatggtcgtcagcatggccaccct

SEQ ID NO: 83294 - DNA, 289 bp, Zea mays
  Clone ID: LIB3114-056-P1-K1-C2
gcaacagaggatgtaggggtttcgtatgtgcgacctgaggacgtgaagtcacggattcagaggttgttcaaagcaatggccaagtcatagtagagtggctttcctggctgctctatgctctatagacaatctttgtgttgatgtatcttgttctcacatgttcaggctagtagagttttagggttacaggttcttccccttcattgctcttctctttttctctctttggcctgcttcagttttgtagcggtgttgtgtaattctattctttttaatgagaatgcttgcc

SEQ ID NO: 83295 - DNA, 230 bp, Zea mays
  Clone ID: LIB3114-056-P1-K1-C4
gagcagacagaaaggacttgaacgtgaaatattttgaaacacatgggcatgccggtccctgacattacatattacaagtatacccgtacgtactcgatgatctggttgacacatcacatcaacatatgagtttaccgatggagctggtagcgtaattagcggcccattctttgcgccgtcggggggtacatcgatatgccggcgccggcgtaattattggccgccttctg

SEQ ID NO: 83296 - DNA, 318 bp, Zea mays
  Clone ID: LIB3114-056-P1-K1-C6
acctcatgctggatatataaacccagcagctgcatcaccattctctgtccctgggagcgggtcggggagacgaggtggtgtaccatatggcggacctggagccacgtatggtggctcccctagctttgcaaccgggggtgggcagcaaccattccgtcgttaggtctagggctgtttgttgaaactgaaagctccttgttttctggctaatagggataatgtatgcctccaagctattcaagcatacttgttcaagtcttggtggatgctggatattggacgtagtgtagtacacattctatggtactgggtttgctt

SEQ ID NO: 83297 - DNA, 394 bp, Zea mays
  Clone ID: LIB3114-056-P1-K1-C9
acacactctaactactggggttattagtggattggggagggaaataccatctcccaatgggagagcgatccgtggggctatacagacagatactgctataaatgctggtaactcaggaggcccacttattgactcttatggccatgtaattggtgtcaatactgctacattcacacgtaaaggatctgggatctcgttcggggtgaacttcgccatccccatcgacacggtggtgcagtcggtccccaacctgatagtgtacgggacctccgtgagcaacaggttttattaactgtgttgtacatcatcatgatccgttccagagcgtgtactcactctgtctttgctacgctctcgttactccatatatgcgtacttgtgtgtgttaatttct

SEQ ID NO: 83298 - DNA, 196 bp, Zea mays
  Clone ID: LIB3114-056-P1-K1-D10
ttaatcttaaacacttgttgagaataaaaaaaaaaaataaaaaataaaaaaaaaaaaaaaaaaaaataaaaataaaaaaaaaaatataaaataaaaaatatataaaaatggggcggccgctctaaaggatccaagtttacttaccctttcatgccacgttaatattctttttttggggccccaaaattcaaataca

SEQ ID NO: 83299 - DNA, 296 bp, Zea mays
  Clone ID: LIB3114-056-P1-K1-D11
atatttttttattcgttttctttttttttttattttttttttttttttactttttcatttttctttttttaaagacccgggggtataatatactaaaaggctcgctttacaaaaaacatggcttgagggcaagagctcaaaacaacaaagttgtggttctcaccccggtgcaaaaacacccccctcaactaaataaattcaccctcaggaccgaattcaccccttcactccctttttttaagaaataacaaccccccatggctcccgttcccccaagtatatatatcaatgggggg

SEQ ID NO: 83300 - DNA, 423 bp, Zea mays
  Clone ID: LIB3114-056-P1-K1-D3
ctcctgaagcccaacatggtgactccaggctccgactccaagaaggtgacccctgaggtgattgctgagtacaccgtccgtaccctccagaggaccgtccctgctgctgtgcctgctgttgtcttcctctctggtggacagagcgaggaggaggccacccgcaacctcaatgccatgaacaagctcagcaccaagaagccgtggtccctgtctttctccttcggccgtgccctccaggcgagcaccctcaaggcctgggctggcaaggtggagaacctggagaaggctagagctgccttcctcgccaggtgcaaggccaactctgaggctaccctcggcacctacaagggtgatgctgtcgccgacaccgagagcctccacgttaaggactacaagtacttgagttgcttttctttgcgtgcc

SEQ ID NO: 83301 - DNA, 104 bp, Zea mays
  Clone ID: LIB3114-056-P1-K1-D6
aaaaaaaaaaaaaaaaaataaaaaaataaaaataaaaaaaaaataaaaaaaaaaaaaaaaaaaaaagggggaattttatataatatatattaaattatataaaa

SEQ ID NO: 83302 - DNA, 97 bp, Zea mays
  Clone ID: LIB3114-056-P1-K1-E10
cccacgcgtccgaaaaaaaaaaaaaaaaaaattaaaaaaaaataaaaaaaaaaaaatacgggagaaaaaaataaaagataaaaaatagaatataaaa

SEQ ID NO: 83303 - DNA, 69 bp, Zea mays
  Clone ID: LIB3114-056-P1-K1-E11
aaaaaaaaaaaaaaaaaaaaaaaaaaaaaaaaaaaaaaaaaaaaaaaaaaaaaaaaaaaaaggaaaaaa

SEQ ID NO: 83304 - DNA, 277 bp, Zea mays
  Clone ID: LIB3114-056-P1-K1-E12
gatgtgtgggcccatcctggcttcggccgagttatcttatctatctatagtatcgtgttaccgttcgcttctgtcaccgtgttagtgtccgttctacctttggattaggtgttggtaccctgttgttcgctttggttgctcccgctatgaaacgagacgagagaagaatgagcaaggtttttgttcgcagctatttttgtccaatgatattgatatattgttccccaaaaaaaaaaaacatattttaatgataaaattaaaaataatcaataacaaa

SEQ ID NO: 83305 - DNA, 373 bp, Zea mays
  Clone ID: LIB3114-056-P1-K1-E2
ccaagaactgtcagctagctgagcttgaattggctgacctaaaatctgtccatcctgtatttgaggatgacgtctatgaatacctgggggttgaaaacgctgtaaacaagttcatatcctatggctctactggttcagaacaagtgaaaaagcagcttgaggattggcgcatccagctcggggtgagctcataagggttggcatggttcaagaaataagctcgcaaattagtgcttgcgatttttgaaggtgtatgttgacgtcgtgaactttttctgtgtgtttgttcatacatttcgaaaactggaatgaatgatgtaaacatgttggacaccttgagcctcttttatatattattatcgcactgtgtttt

SEQ ID NO: 83306 - DNA, 430 bp, Zea mays
  Clone ID: LIB3114-056-P1-K1-E3
ctttctgccagaaaaaaatattatagaaatcataaccgtataccacaaacaaagcagtctgtccacgtaaacgtattccattttataaactatcgggcaactgaccaaggagaataggcaaaccagcataaatctaccgaactgccttcggctgaatctggcatcctctttgtgtctcgggatcagatcacatccaatcaacataatcggaggatgattttgctcctctttggggcttcttatacctgttattctcgaacttcgcttttgaaaggagggaatccagaactgctgcttcagcaagatcgtaaggcaccatcaacacactagcaagaacatcctccaaaatagtgcgttggcaaggcgtcacatagtatatgcactttcttggacactgcccaacagcgagctggacaagatcatctgacta

SEQ ID NO: 83307 - DNA, 114 bp, Zea mays
  Clone ID: LIB3114-056-P1-K1-E4
cctgcagtaccgtcctgaattcccgggtcgatcccgcgtctgtaaaatatataatataaaaaaaaataaaaaaatatataataaaataatatataaaataatattgagggtaaa

SEQ ID NO: 83308 - DNA, 167 bp, Zea mays
  Clone ID: LIB3114-056-P1-K1-E5
aaaaataaaaaataaattatataataaaatattattatttaaaaatataaataaaattatacgtagaggttaaaataaaataagttttatttgttatttctttttctaactataatattattattcttgttattcttattattcattattttattatatttttaatt

SEQ ID NO: 83309 - DNA, 259 bp, Zea mays
  Clone ID: LIB3114-056-P1-K1-E6
aaaataataaatatataaataaaaaaatataaaaaataaaaataaataaaaataaaaaataatagaggggtgaaattgaaaatgtaaacaaatttaaactacataactacctttatattaaaaataatgggggccgccgttcaaagaattcatttttttctatcgcgctcttccaatgtaaaagttttttatttggttacacctaaatttatttttgtgcccgttgtttaaaaactttttccctggaaaaacattggtt

SEQ ID NO: 83310 - DNA, 327 bp, Zea mays
  Clone ID: LIB3114-056-P1-K1-E8
aaatataaaaaaaatttaaataaaaaaaaaaaaaaaaaaaaaaaataaaaaataaaaaaaaaaaaaaatatataaaaaatataaaaaaataaataaaaataaaataaaaaattaaatgggaaaaaaaaaaataaaaataaatttatataaataaagggggggggggttttatgagaaacaattttaatttatgtgttttttcttatattatttttttttttgggttatcttatattaaattttttgggtgttttttaaaaaagtttttgttgttaaaattttgtgttttctaaatttatatattttttgtataaatattcttttttt

SEQ ID NO: 83311 - DNA, 460 bp, Zea mays
  Clone ID: LIB3114-056-P1-K1-E9
gttcgcctgcagtaccggaccggaattcctgggtcgacctacgcgttcgaataaaaaaatatattgtttaatagataaaaatataaaatatataaaaaaaaatggggggtgaaaataaaaaaattaataaattaaaaaaaaaaatataaattttaataataatagattaaatataaattatattatttttaaaattataattaatgggggtgcttttttatttttaataattttaattatatttttaatataatataattaaattttttttatattgtttttaaaatatattatatatgttgcttatatgttataattacttttatattggagaaaaatattgtatttttaacataattaatattgtgattatataaattattatttttttcatattatgtttttttaattataatattattaaaattattatcaatcttttatatataattttttaaat

SEQ ID NO: 83312 - DNA, 380 bp, Zea mays
  Clone ID: LIB3114-056-P1-K1-F1
ccggcgcggcctacggctggtggtgatcgatcgccagctccatcgccgtgcccaccggcctatcggagtggtactactacggtacggtctaccatatgagctggtgcactgcatgcccaccgccgcaccagtacctcctgttacttgttcttggagttaggagtttttttaatctttaggagatggatttggttgtatgtagtagcatactagcatgagctgtggagcttcttctcttggtgagtgatctcgtgtcttgtgagggaaggaggaagttcatgctgtgggtgtcctactcctctttacagaacagatatctggactctggtctatgtaaatataggtgctgcgtatgtatatatgtgtgtatagaataaaat

SEQ ID NO: 83313 - DNA, 192 bp, Zea mays
  Clone ID: LIB3114-056-P1-K1-F3
aaaaaaaaaaaaaaaaaaaaaaaaaaaaaaataaaaaaaaaaaataataaaaaataataaaagaaaaaataaaaaaaaaaaaaaaaaatatggtcttaccgatggggcgtcaagcttgttccatgctgttttgcagttctgcttggtttgaacttcgaaacatgatatacaccaaggttcattgatttgctg

SEQ ID NO: 83314 - DNA, 353 bp, Zea mays
  Clone ID: LIB3114-056-P1-K1-F6
aaaaaaaaaaaaaaataaaaaaaaaaaataaaaaaaataaataaattaaaaaaaaaaaaaaaaaatagggataaaaaaaaaaaaataattatattaatataaaaataaaaataaataaaaaaaatattataaatattatggggggggccttttttagaggttccactctattatcccctttctgcaaattcatattttttttttatgggccacaaaataaaattactttgctctttgttttttactttcctaatttgaaaacccctgggtttacccaatttaattttcttgtaaaaaaaacccctttttccatgttggttaaattaaaaaaaagtcttaactttttccccttt

SEQ ID NO: 83315 - DNA, 70 bp, Zea mays
  Clone ID: LIB3114-056-P1-K1-F8
aaatctgaaataatataaaaatataaaaaataataaaaaaaaaaaaaaaaaaatagtaataggttataat

SEQ ID NO: 83316 - DNA, 425 bp, Zea mays
  Clone ID: LIB3114-056-P1-K1-F9
agaaagaggaatctctcgacaacattaatctattttcgataattacagtcatgtcattctttctgttggccccggtaaccttacttacagaaggtgttaaagttagtccagcagttttgcagtctgctggtttgaacttgaaacagatatacacaaggtcattgattgctgcatgctgcttccatgcataccaacaggtgtcatacatgatcctcgccagggtatccccagtcacacattcagtgggcaattgcgtcaagcgtgtggtggtcattgtgacctcggttctgttcttcaggacccctgtttctcccatcaactcactcggtaccgggatcgctcttgctggagttttcctatactcgcaattgaagaggcttaagcccaagcccaaagcttgttgatcatagacctttgcaggtcca

SEQ ID NO: 83317 - DNA, 298 bp, Zea mays
  unsure at all n locations
  Clone ID: LIB3114-056-P1-K1-G11
agagtttttgacagattggactggtagcttccccagggtcagaaaaaagaatgtgactcactgactgtaggggaatgccatggaagtgtagatgtgatgtttcttctcaattgtatatgccattggattgatgtttggaaattttacgtgtagtatgtctaagataagtccttttatgtactggttccgtgaacctataaaaatgcttcagctagttcttgagcccaaaaaataatattnttaattataaaaaaaaaaaaaaaaaaaaataataaataataaataattattataatat

SEQ ID NO: 83318 - DNA, 375 bp, Zea mays
  Clone ID: LIB3114-056-P1-K1-G12
tttatttttttttttttatttatttttttgttcgtttattattttgttttttatatatagtgtttttttttttttatttttttttttttattttttttatttttttttttatttatattatttttttgttatttttttatttttttttttttttttttttatttttttttttttttttttttttttttttttttttttttttttttatttatatttttttttttttattttttttttttttttgtttcttttcttttttttatttttttttgttgattttttttttttattctatattttttatttttttattttatatataattacttatatttatctatctttctttgatattatttatatttttatttgttt

SEQ ID NO: 83319 - DNA, 129 bp, Zea mays
  Clone ID: LIB3114-056-P1-K1-G3
agaatatgtactcgctaacttgtatctaaagcatatatgtttttcacatcgcaaaaagggagtgagaaaaaacaaagataaaaattataaatacaaatcaaagatagaataaagggggggccctctttt

SEQ ID NO: 83320 - DNA, 265 bp, Zea mays
  Clone ID: LIB3114-056-P1-K1-G4
aaccatggatgatatcttcaaggacgatgagccggacagctacgccgacaagaggagctagtttgtgccttctccaaagagtgctcatcaatacgattccagaacgatatgtattggctagtgtttgctgttaacatcatagcggcctgtatgttcaaataatggagcgagtaattctgatgagtttgagttgtcgggggctgtggaactttcaaacatggcgtgcatccacgttataatgtcgttttgctagatgctatgcttt

SEQ ID NO: 83321 - DNA, 184 bp, Zea mays
  Clone ID: LIB3114-056-P1-K1-G5
aataaagggtctcgaagaatcgggtgggctttcttccactatggaccttgggccttatatcagctcgtgttatccttctcgcatataattcacacccgctctgtaatctgtacgttggttggtattggcatcacatgacaacaaggccctctttgttaaaaaaaaaaaaataaaattttaaaat

SEQ ID NO: 83322 - DNA, 347 bp, Zea mays
  Clone ID: LIB3114-056-P1-K1-G6
cgtcgtcgtctccgcctgttttcccctctttccatggcaggctgatgctcttcaacacacacaggccactgtcgctcctcagttataagtagctagggcatctggctgctggaaaatcaagcacgcatccaccacacacacagctagctagcagatcgtttcgagtgaagatccaaagaggtagagagatggaaaggatgagttcgtcgctgcagtactgggtggaggagcacaagctcttaaccatctgagccgtgtgggcgactgcggtgggcgcgtctgtggcgtacagccggcagctgtcgccggcacggacgacgggcatgctccttatccacgccatgatg

SEQ ID NO: 83323 - DNA, 259 bp, Zea mays
  Clone ID: LIB3114-056-P1-K1-G9
atcaaaattctcatggtatactgatttcattattactacaaaattgcggtgggcactgtcgggacagcagctcactttcaatggcaacatttgaagtaatttctggcgcagccattcatgaaaattgctttaggtatcacatgtgacaaacggctgcatacaattgcagtggtttacgtttagctcataaagtgcaaaactggaatgggtcttatatgtttcttggagttatgtttgtctagattctgtgttggaattt

SEQ ID NO: 83324 - DNA, 131 bp, Zea mays
  Clone ID: LIB3114-056-P1-K1-H3
ggcggggagaaggaattgctgtagtgcgatgttgggtggctcacctgttcatatggctcttgaactgattgaagggttagcaccgcataataaaaataaataataattattaaatattattatattttaat

SEQ ID NO: 83325 - DNA, 272 bp, Zea mays
  Clone ID: LIB3114-056-P1-K1-H8
agctagctactgtagtgtaggttgcttggtcagtcggcagaggatctggtcgcaggctgcaagtgcgaccatttagaatgctgtaactgctgcattttctcgttattgacgcatggtgcttgcgatgtgatgtgctgaagtgcgggtggcaacgcggaagatctacgacccgctggaggaggacgcctttcgtcccattctggaccactacgaacggcccaaatttccgcttgaggcttttcgttaacggaaggccttggcctttcttttac

SEQ ID NO: 83326 - DNA, 138 bp, Zea mays
  Clone ID: LIB3114-057-P1-K1-A1
accattcacgaattcccgggtacgacccacgtcgtcctaataataatatattaatattattatattaatttctattatttaaaataaattaaaaaattatggtttagggttaaaaaaaaaaagggggggggcttttta

SEQ ID NO: 83327 - DNA, 450 bp, Zea mays
  Clone ID: LIB3114-057-P1-K1-A12
ccggtccggaattcccgggctagcgccgccgccgccccatgctcgccttgcgtgactgagagctcgtcggcttccgtccacgcgtgaagcgagagcatggacacccaggtgaagcttgctgttgtggtgaaggtgatgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggccaggaggctgcgctgaagccctagcgttcttggtgggctcttgtatggtctttggtgtcttggaatttgtgctatgtttgaacttctgtgaccctgttttaagagtagtaagcctggttataagattgcaggtttgtttatcttgggtgaaagtgcaattggtgttgagaca

SEQ ID NO: 83328 - DNA, 87 bp, Zea mays
  Clone ID: LIB3114-057-P1-K1-A8
tttcggtgagaatccaaacttgggtgcgcgtgcctacacaaattaaacttttttaaatgtggtacccaaatttaattaacttgacga

SEQ ID NO: 83329 - DNA, 301 bp, Zea mays
  Clone ID: LIB3114-057-P1-K1-B3
cacgcgtgcggctgcaagaagggcctgtcgacggaggcgctgtgcagcctgaggagctggctggatacggaccaccggtagagggaggaagagctggggggtgtgtaaatactggagtattatgctgacagcaacactggttgattatgagcgctgggccatctgttgaggattttacgtaggctggttcagcagccagcagttttgtaggtttcgttcttccttttcacccttgttatctagtcgtttgttgtacatacatgtatggatgctgctgatgacatctgtgtgctgcgctcca

SEQ ID NO: 83330 - DNA, 225 bp, Zea mays
  Clone ID: LIB3114-057-P1-K1-C1
gaccagtacccggcgcgcatggacgcctagcacgtacctgcaatgcaatggctgctatctatctatcgctcgcttcgctatctaccagtgcagtgctgcacttcaccgatgcatgatggatcggatatgatatggtataggacgcagtcggtcgatttgcatgcatgcaccaagtgttactataccgttctgaaggtacgtttgaactttgttcgtttgtattgc

SEQ ID NO: 83331 - DNA, 363 bp, Zea mays
  Clone ID: LIB3114-057-P1-K1-C7
tcctgcagtaccggttcggaaaagctcggcgacccacgcgttcgggaaaaggtgtcactttcatgtcatttagtggtgtcatgaagtaatgaaggggtgaggtacttgtgggcaaatccagtgccgaaggctccccacatgagtaccttctggagaaagggctccccagctgctgcgaacccacgacctcagacagctcccatcactgcatcaggcctgaccttctgaatttgtgagctactgtataaaataaatgtgtcctgaattcatgtgatcttgtaataagactaggcttaaataaaaactacgatttcaccgtgttctctatgctattcggcatttggaatgtatgatggttaacat

SEQ ID NO: 83332 - DNA, 400 bp, Zea mays
  Clone ID: LIB3114-057-P1-K1-D1
gtgctgatccagtggttgttgctgaggatgggaaggtgaaaacgttccctgtgatcctattgcccaaggagaagcttgttgacaccaacggcgcaggtgatgctttcgttggaggcttcctctcacagttggttctaggcaagggcattgaagactgcgtgagggcaggttgctatgccgcaaacgttatcatccagcgcccgggctgtacttacccggagaagcctgacttcaactagtgcaaaactgaggcacgtcatgagagggactgttataggcacacttaattgttaaccagtgcgtggttcggtgtctacacaccctgtattcttccgaggcttcttttctgatccggccaatatttttgccgtgaaatttgtgttctgcaactatggacgtc

SEQ ID NO: 83333 - DNA, 362 bp, Zea mays
  Clone ID: LIB3114-057-P1-K1-D11
cttccagactacaactggttcagacgccggacctacatgctccgttactagattaatgagccggtgtacccatgtttaccgtctgcaaaagacaagataaaatttgcctcttttagcgtcagtatattaaggcctcagcactgcacattacgtgctgcgatggaggaattttttgagaatatgttgtatttcttgtcgggtccaaaatccacaaatctgtcaataatgataggcaggttcgactgacgtggctgacttggttggccaccggattgttttcttacaacgagtcatgaaccatacccgcccatcttttgttggaagattttactttggcaaattatttttgtggcacgttttat

SEQ ID NO: 83334 - DNA, 256 bp, Zea mays
  Clone ID: LIB3114-057-P1-K1-D2
taactaaatacaaatgtaaaaaattaagatgataaaagtgtaaacaaaaaatataaatcgggaatacaaaaaaaaaagattgtggacaccgggcggcctttctatagcttccaatgtaagctccccttgccagctggttcataggctatgcaattgggtgactgaatgtagagctcgttgccataccttatacaatatcattcatggacaaacctgtgcgtaccccaagaaatctgccttaaaaaacatccccttt

SEQ ID NO: 83335 - DNA, 92 bp, Zea mays
  Clone ID: LIB3114-057-P1-K1-E11
aaaaaaaaattaaaaataaaattaaataaataaaaaaaaaaaaaaaaaaaaaaaaaaaaggggataaaaaaaaaaaaaaaaaaaaaaaaaat

SEQ ID NO: 83336 - DNA, 407 bp, Zea mays
  Clone ID: LIB3114-057-P1-K1-E12
ggacctggaagttccaacagtgtgcggattggatctccaagaagaccagtagcttgggcaccagtggcagctcggacatctgcttcaggttctcgtccttcttcgcctaggtcactcgttgatggtgaaggttacaatagtgctgatgaacagggtccctgttacgcctcgagttatgatgattcggaaagagagcgtatgtttgagcatgacctaaggcgagtgaaagggttggaaatcagaaagacggccgaagatgggaactgtctattcagagctgttgctgatcaagtttatggagatgcagaagcttatgacatggctaggcagatgtgtgttgattatatggaaagggaacgggatcatttctctcaatttataactgaaagttttacattatactgcag

SEQ ID NO: 83337 - DNA, 275 bp, Zea mays
  Clone ID: LIB3114-057-P1-K1-E2
aactaattataaaatagtaagcaaacaaatctataaaaaaacaaactaacatacacaaacagagatacggaaaaactaataattgagagtaactaaaattcaaaattactggggcggccgttttagaggacccaacttttaaaacccttgcttgcacccaaataaatcttctttaaggacacctaaattaaatcagctggccgtatttttaaaacgcccggactggaaaaaccttggcataaccaaactaaattgattggaaaaaaaacccccct

SEQ ID NO: 83338 - DNA, 182 bp, Zea mays
  Clone ID: LIB3114-057-P1-K1-E4
cggtccggaattccctggtcgacgcccgcgtccggaataatacgatgggagttgttttgttgttcatgtcaatagtatatgaattgtctttggaagcatgcaaccttttaagttggaacacatgttatcttgttttgacaggtcttgtttgttttgtctgctactgttggagtgttgggcat

SEQ ID NO: 83339 - DNA, 138 bp, Zea mays
  Clone ID: LIB3114-057-P1-K1-E7
gcagtaccgttcgattactcctcgacgccaacatactgactaggtctagagcgcgagcgagacgatctaaaggatccaagctcacgtacgcgtgcgtgcgacgtcataactgttctatagagtcacctaaaatcaatt

SEQ ID NO: 83340 - DNA, 223 bp, Zea mays
  unsure at all n locations
  Clone ID: LIB3114-057-P1-K1-F12
aggaaaggaagtatgtgcttggcttgcgaggagggggcatatttctgttcaacttttcttacgggtcatgttacttgtcatctcanattacacaactttaggtatttctgtctttgtgagaaaagtaccaaaatagtttcacaaaaaaaaaaataaaattttataatgagttaatattttaaaaaaaaataataaaaaaaaaaaaaaggtaaaaaatataaaa

SEQ ID NO: 83341 - DNA, 366 bp, Zea mays
  Clone ID: LIB3114-057-P1-K1-F2
cacgcgttcggtcttttatgaagactggaggagagcaaccaggttatatggcatcatgcgtgggagcagagcgagcggcattctgaagtgcagccgcaacaactcaatggcaataactttttccatcccctcgatggtgctggtgaacccacccttcagatagggtattcttcagaggcactgactagctcatgcatgaccaccttcctgcccccgtggttgccatgagatcgaactactgagcatttccgaattaatatacatgggcagatgcatctgcctgtgctatacgttgtgcttggagtgtactttaagggtcttgcatggcaagtatgtgtgtaacatttgtgatgaacatggaaacta

SEQ ID NO: 83342 - DNA, 334 bp, Zea mays
  Clone ID: LIB3114-057-P1-K1-F5
ctcgtgtgcaagttcgacaaaaactttggattcacatatcttggaaagggttcaacaacaatgattttatgggtgttttgtaacgcatactctgttctgtttagcatgttcagcgaaggttaggattgctagaaggcaggccacggcgtctattgctgtaacttgtttccgtgttaattaagtggtgcggaatacatgttgaggcagttgggttcgtcttggaatgctatatcctataactacttgggtgtttggttcgaagaatgagatattacatcatcttctcacttttaaaaaaaaaaaaaatagggcggtcgttctagaagatccaagt

SEQ ID NO: 83343 - DNA, 372 bp, Zea mays
  Clone ID: LIB3114-057-P1-K1-F6
cggtccggaattcccgggtggagccacgcgtgcggtacattcttaaggttggtgaaggacatgctgcccagtgcatcagcggattcacaggtgtggatatgccaccaccccgtggccctctctggatcttgggtgatgttttcatgggagtctaccacaccgtttttgactatggcaagctgagggttggcttctcatagtcggcctatggattatggtttggcagcaacccgtccagaggcaaacgcgtaatttgggtgtttatgcgaccggggatgtgtgtatatatgctactacatgtttagtgatgctttccgagaccttgagacaacgcccgtttgttttaacgtggcgcaggaataattctggttc

SEQ ID NO: 83344 - DNA, 313 bp, Zea mays
  Clone ID: LIB3114-057-P1-K1-G2
tatagatgttacacgggggtcaatatattgaagtaaatttgcaacattgttcatgtggtgagttgaaccttgtgtcgtgtaaaactggaagtgggtgtattctggccatgtgatctgggtccaagtttgcaggttttgtcgttcggctaaatcccttaaatgtgagacttgaaatatagaataaaagcgaagctgagtacatggaaatttgtgattgctggattgcaaaaaaataaaatataattattaatagatgttagtatttaaatgatttaatatattatttataactattttattatattaaatatta

SEQ ID NO: 83345 - DNA, 256 bp, Zea mays
  Clone ID: LIB3114-057-P1-K1-G5
ttggcagcgctcgagaaggactactaggaggttggtgctgagtttgatgagggtgaggaaggtgatgatggtgatgagtactaaaagtatcctgatgcggtcatcgtcaggcttgtgtgctgctcttgtccccgttgtggtttgcaacacctgatgttgtaagactttctggttatgtccgacccggtgtgccactgggttatgaagaacgtcgatatgggatggttggtaacacttaaatataaaaaaatatagg

SEQ ID NO: 83346 - DNA, 406 bp, Zea mays
  Clone ID: LIB3114-057-P1-K1-H1
ccggattttccgggtcggcccacgcgtccgatcatctctttcttatcagagaagatgaggtttcagtatggtgctactggttcctcatgtatgtgggctgcctcctaactcgtttagtggtagcactaaaggtgatgttttgtaagtgaggtgtggtatcattgtttgagccttggctagagaaacttacaaatgtgcaagcaagaatgggtgaagcatttagtttggtgagagctggtgctgagcgaatcacttgtccttgaagggattgctatggggtagctgacttgtctgtggaacttccctatagtgacatgcagtcaatacttgcatttttttcaattttcctgtgtcccagttcgatcatttgaatcaaatcactcttttttttaataaagtgtatttc

SEQ ID NO: 83347 - DNA, 287 bp, Zea mays
  Clone ID: LIB3114-057-P1-K1-H10
gcaacagaggatgtaggggtttcgtatgtgcgacctgaggacgtgaagtcacggattgagaggttgttcaaagcaatggccaagtcatagtagagtggctttcctggctgctctatgctctatagacaatctttgtgttgatgtatcttgttctcacatgttcaggctagtagagttttagggttacaggttcttaccattcattgctcttctctttttctctatttggcctgcttcagttttgtagcggtggcgcgcaattctattcttcttaatgaaatgcttgc

SEQ ID NO: 83348 - DNA, 301 bp, Zea mays
  Clone ID: LIB3114-057-P1-K1-H7
ttgttaaaaagagaatagagattttgagaatagacaaatcattctgaatgtcatccgatgatctgagatgggccaaatgcataaactgggaaagttgtaacgcttaacaagaaaaccaaaagttggacctcagtcaatacattatgtgtttatagagagaactttgaagcttcatgcgccacaattgatgaccagtaacagtggtcattcaactggcccaagaagttggaaagaacaaagggcttaagggtggtggccgcttttttttaaaagcctttctttccatcggtttttgaatcaa

SEQ ID NO: 83349 - DNA, 254 bp, Zea mays
  Clone ID: LIB3114-057-P1-K1-H8
aagcgagagagatccggagcagccggagttccaccgaccccgccgccgggcgccctacatctcctcgccggtggctctcgatctttgtacagtttctcttttcaataatcaagatgagccgtggtggtagtgccggtggtggtcaaagttctctggggtatctctttggaagcggtgagccccccaaaccagcagtggcaccatgtgcaagtgctccacctggtgagaaaccattttgtgctaagaactgatgc

SEQ ID NO: 83350 - DNA, 241 bp, Zea mays
  unsure at all n locations
  Clone ID: LIB3114-051-P1-K1-A7
cgaaatncccggcgggacccactcgtcctaactagttctagatgggtgtgcctccttttgcactctggcatccgtggaacacggggctctttcctacagtctacgagtgtgtgatggacgaattccatgccggtgggttagcattatcgatcaatgcatggattaacgtgttaccaaattaatttttttgcttaactattctttttttgcacgcttcattattatttgtggggggtcgctc

SEQ ID NO: 83351 - DNA, 440 bp, Zea mays
  Clone ID: LIB3114-051-P1-K1-B1
atctccgacttcctgcgccgcttcgggtggatcgtgccggcctacacgatgccccccgacgcgcagcacgtgaccgtgctccgcgtggtcatccgcgaggacttcagccgcaccctcgcggagcgcctggtgctcgacatcgagaaggttctgcacgagctggacgcgctgcccgcccgtgtccccagcggcgacctagccgcgctcgccgcggccgagtccagcgagagggagatggagaagcagcgccaggtgatctcgctctggaagagggccgtcctcgccaagaagaagaccaacggcgtctgctaagcagccgagccgacgcatttctggccgtattggcatggggtgaaatttgtctgagtacgcgtttgcagtttttacccgggtgaagattgttatgtgtcgaggttgagttttagaggacggaattgctc

SEQ ID NO: 83352 - DNA, 221 bp, Zea mays
  unsure at all n locations
  Clone ID: LIB3114-051-P1-K1-B11
cgcctgcaggtaccgntccgnaattcccnntgggagccacgcgtcctaaaaaaaatataaaataaaaaaatataaatattaattaaataaaactaataaaaaaaattaggggggatataaaataaaattaaggggaggggctccctcttaaaaggaaccaaccttactttcccgtgcatgcgacgtaataactctactatagggtcacttaaaataaatta

SEQ ID NO: 83353 - DNA, 67 bp, Zea mays
  Clone ID: LIB3114-051-P1-K1-B2
attcccggtgcgacccacgcgtccttaaattcattctcttccccatttaaaaaaaaataataaaaat

SEQ ID NO: 83354 - DNA, 68 bp, Zea mays
  Clone ID: LIB3114-051-P1-K1-B9
tccaagtttactaacccgttcatggggggttataacaattgaataggggcacctaaaataaaattaat

SEQ ID NO: 83355 - DNA, 353 bp, Zea mays
  unsure at all n locations
  Clone ID: LIB3114-051-P1-K1-C11
tgttacgcctccagntaccnntccnnaattcccgtttggacggacgcgtccgaaaaaaaatattatttttgatatttaaaaaaataaaaataccaaaaaaaaaaaaaaatataaagggggaatataaaataatgaggggggggaatatatttaaaatatataaatttaaggggcggccgttttaaagaatccaatttatcttacccttccttctcaatttaatattttttttattagttcaccaaataaaatttaattggcctgtgtttaacaacgtttgtactggaaaaacccttgcgttttccaaactaattcgctttgaaaaaaatccctttttctcaagtttgtcataa

SEQ ID NO: 83356 - DNA, 225 bp, Zea mays
  Clone ID: LIB3114-051-P1-K1-C2
ttccatctctgtgtgtgtgacagtgtgtcgtagctatagcagtggctgtcgcgtgtactggggggtgcggactgcgagtgacatgggctaaataaagtgtgcgtcgtctggtctggtggtggtagtggggcgcggtgccccatgtgtgccgttgcagcttgcgtgtctgttttgcttcattggtcctgtctatctactcttatgtatggtattttggtttatttt

SEQ ID NO: 83357 - DNA, 101 bp, Zea mays
  unsure at all n locations
  Clone ID: LIB3114-051-P1-K1-C5
attcccgnntcggccgacgcntccantttgaattaatcctggtcctttggtcgactatcttctgccttggcacccacgggccaaccggagtggcctgtgtg

SEQ ID NO: 83358 - DNA, 196 bp, Zea mays
  Clone ID: LIB3114-051-P1-K1-C8
tgttacgcctgctaggtaccggtccggtaattcccgggtggagccacgcgtcctgaatataatatttaataatgaaaaaaataaaaaaaatataaataaaaagtgtataatatttggggggatattttggtggggggggtgttattatttctttttttcctcttttttttttttgtgtttttttttattttttttt

SEQ ID NO: 83359 - DNA, 66 bp, Zea mays
  unsure at all n locations
  Clone ID: LIB3114-051-P1-K1-C9
acgcctgcagtaccgntccgnaattccctnttcgacccactcgtcctaaatattacactttcttat

SEQ ID NO: 83360 - DNA, 55 bp, Zea mays
  Clone ID: LIB3114-051-P1-K1-D1
gctacgacgcgtcatgcggcgcatagctcttcgatgggggcacctaaattcaatt

SEQ ID NO: 83361 - DNA, 337 bp, Zea mays
  Clone ID: LIB3114-051-P1-K1-E3
aaaataaaattttttaataaaaaaaataaaaaaaaaattaaaaaaaaaaaaaaaaaaaaaaaatgtcgtcctcactaaaaggtccggggttctctaaccctttcttcctacttcatacttcttctatatactcactaaaattcaatttactgtcccacgtattacaacattctttacttttaaaaccctttctttacccaactatatctccttgcagcatattcccctttcttcaactagcttaatattcaaacaagccctcaccaattgccctttccaacatttttcaacctctaattcaaatgtcaccccccctttatcagctcattaaccccct

SEQ ID NO: 83362 - DNA, 285 bp, Zea mays
  Clone ID: LIB3114-051-P1-K1-E6
ttttaaaggacccaagctaacttacccgtgcatgcaacttaaaaatttttttaaagggataccaaaatcaaattaactggccggcgtttaaaaacgtcgggattggaaaaaccctggggtaaccaaataaaatagctttgaaaaaaatcccctttttgccaggtggcgaaaaatcaaaaaggcccccaccgatcgcctttccaaaaatttgcccaccctaaatggcaaatggacccccccctgaaagggccaaataagcgcgggggtttggggggttacccccaa

SEQ ID NO: 83363 - DNA, 108 bp, Zea mays
  unsure at all n locations
  Clone ID: LIB3114-051-P1-K1-F11
tacgcctgcaggtactcnntccccaattcccttgtggacccacccttcacttactattttccatatcgcgagctactcactcttatattatccaagcttactctactc

SEQ ID NO: 83364 - DNA, 125 bp, Zea mays
  Clone ID: LIB3114-051-P1-K1-F3
aatattattaatttaaataaaaaaaaaatttttataaaaaataaaaaaaaaaaaaaaaagggggaacaaaaaaataagtgaaggggaataaaaaaaaaataatttttcttattattattatatat

SEQ ID NO: 83365 - DNA, 195 bp, Zea mays
  unsure at all n locations
  Clone ID: LIB3114-051-P1-K1-F5
tacgcctgcantaccantccnnaattccctnttcgagcgacgcttacgggacagcgcctaaggcagcgacttcaagctcctgtctggggtcagcggctgcgtcccgctgagcgtggtctctgggggggcggggtcactcttcttatggacctacctcctatcaaagtagcagcggcggtttttttttacccttct

SEQ ID NO: 83366 - DNA, 390 bp, Zea mays
  Clone ID: LIB3114-051-P1-K1-F7
actcatcctatcaattcccagtattaccgtgtatcttttgcattcttctacaagtgcaactttgatgctggggtagatcctgttgagggctggcgggagaaaaccggcgttgctgttaagttcaaaaaggttgtgtacggggagcatttggttcataaagtattgacgaacttcttcatgtaaatttgctaagtacgacaaataaatttgcattgtagcatcagaacttcagacctatttggtgtgtagtgctgtactagaaaggtatgtaacgtgctaaagcatgcgcccgtctttgatattagacctttacaagagttttagacatttctgttcaagtgttatcacaaggtttatcggtggagatttgttttttttgtttgacggagt

SEQ ID NO: 83367 - DNA, 423 bp, Zea mays
  unsure at all n locations
  Clone ID: LIB3114-051-P1-K1-F9
acgcctgcaggtaccnnnnccnnaattccctnttgggcggcacgctactcatactatttactagtatcgcgagcggctcccttctagtattatccaagtcttacgtactacttacatgcggacgtcataaactgttgctatagggtgcaccttaaattcaatttcactgcgccttacgtttttacaaacatcattgacatggtaaaactcctggtcgttactccaatcttaatctgcctatctagcacatctccctctttccgtcaagctgtctgtaatatacttaagaggccctgtacccgaactgcccttcccaacaatttgctcatcctgtaatggtctaatgggactctgccctggtagcgtgctcattaagctgcggagggtgtggttgattactctcaacagtgactctcttacact

SEQ ID NO: 83368 - DNA, 431 bp, Zea mays
  unsure at all n locations
  Clone ID: LIB3114-051-P1-K1-G2
attcccnggtcggcccacgcgttctattaacattaagtttgtagagagtggagagaaggagaagctgacggagctcctccgcgagcggctcgtcgagtgcggctggatggatgagatgaaggcattctgcagggactatgtaaggaagaaaggaagaaataatgtgagggtagatgacctcattcatgttattgttccgaaaggaagagcatcagtgcctgcttcggtgaaggcagaactcctgcaacgtatccggtccttcatggctaccacactttggtagtcatttatcgtgacggttggagctacatgtaccattgtacgaacactgggaggtcgaacttgttgtgtacctaggtggtaggatactgagcatgaaaaggatcagtgtgatcttcatgatgctatcgacatgtattcttgtcagacag

SEQ ID NO: 83369 - DNA, 144 bp, Zea mays
  Clone ID: LIB3114-051-P1-K1-G7
cagaatttgagttcaagattgctgtgcttacctaggcctgagctttatttatcttggatgggtatggtttgcatggcaccgactgttgtgagcgattactggttatttaccagccgccttgttttatttattgggctggaaatc

SEQ ID NO: 83370 - DNA, 77 bp, Zea mays
  Clone ID: LIB3114-051-P1-K1-G8
ttacgcctgcggtaccggtccgggattcccggggggacgcacgcgtcctaaaaaataaagtgggggataaattataa

SEQ ID NO: 83371 - DNA, 135 bp, Zea mays
  unsure at all n locations
  Clone ID: LIB3114-052-P1-K1-A7
naaaaaaataaaaatatataacataaaatttttctttataaaattttaaaaaattacaggataaaatttgggcggccgttctagaggatccatgtttacgtacgcttgcatgcaacgtatataatccttttatag

SEQ ID NO: 83372 - DNA, 497 bp, Zea mays
  unsure at all n locations
  Clone ID: LIB3114-052-P1-K1-A8
gcctgcggtaccgntccggaattcccggttcgacccactcctncgcatatgctatggagacaaatgacctactttttcctcaacactataatcgatgaccttgttgcatttgtcatcaaaatgccaatgcttcatcgtctctcagttttcatagatgatgttatcttcttgatatacctctatcagaggtggaagtatccggtcgacaagaagcgtgttaacgagtcnggcttagggggcgaggacgaaccggcagcccangaggctgtggaaggaagtgattcagctgcagcaccccanctaacggaggccgggtccgagacgagtacggaggacaagaaaaccaagtgatctccaatcttttgatcatccaaatacaagcatacatttttgcatcatctgccttcctagcggtcgttgaatttctttgctgaaactggatgctggactcttgcggtcttgtcttaccgagacgtgctgaccataagataaggcgt

SEQ ID NO: 83373 - DNA, 194 bp, Zea mays
  Clone ID: LIB3114-052-P1-K1-B1
aaaaaaaaaaaaaaaaaaaaaaaaaaaaaaaaaaaaaaaaaaaaaaaaaaaaaaaaaaaaaaggaaaaaaaaaaaaaaaaaaaaaaaaaacccaaaaaaaaaaaaaaagggggggcccttttaaggggtccaagtttaccttccccggcttggcaagttaaaactttttttttggggcccccaaattcaattcc

SEQ ID NO: 83374 - DNA, 115 bp, Zea mays
  Clone ID: LIB3114-052-P1-K1-B2
aaaaaaaaaaataataaaaaaataaaaaaaaaatattaaataaaaaaaaaaaaaaataaactagggggggggtaaaaaaaaataaagtaccccccctataattatatagtggggg

SEQ ID NO: 83375 - DNA, 495 bp, Zea mays
  unsure at all n locations
  Clone ID: LIB3114-052-P1-K1-B8
gcctgcaggtaccgnnccgnaattcccggntcgacccactcgtccgagcccaccgaattccctgcgattcctctcccctcgcctcctcgtctccccctaggggatcgtcggagaggaatcgcaaagagggccgtctcatccgagttaaggaagccatggagcacaaggaggctgggtgccaggcccccgagggacccatcctctgcatcaataactgtggcttcttcggcagcgcggcgaccatgaacatgtgctccaagtgccacaaggagatgataacgaagcaggatcaggccaagctggctgcctcctctatcgacagcatcgtgaacggcagcgacgccgtcatggagccggttgttgctggcagcaacacggtagtagctgttgcccaagttgagttgcaaacaatgaacgtgcagcagcccgctgatgttgccggacccagcgagggggtggcggcgatctccaaaggggggaaggtagggccgaacc

SEQ ID NO: 83376 - DNA, 161 bp, Zea mays
  Clone ID: LIB3114-052-P1-K1-C3
cgaaagcacgtacggccgcgtgcctggtctagctacgcggccggttgatcttgagcagttaagcgtgtacgaaacgacagcgctgtgtacgtgtactgctgctgaagtgtgagatgtactgtctgtggtatttggtatgatccgatcggctgtttaaagga

SEQ ID NO: 83377 - DNA, 365 bp, Zea mays
  unsure at all n locations
  Clone ID: LIB3114-052-P1-K1-C4
aaaaaaataaataatataaatatgaataaaaaatttaataaataaaaaaaaaaaaanaaaaaaataataaaaataaaaaaaaaaaaaaaaaaaaaaaaaataaaataaaaaaaagggggcggccccctaaaaggtcccaactttacctccccggccatgcaataaaaaaacttttttatagggccacccaaataaaatcaacggcccgccttttaaaacctcccttatagaaaaaaccatgcaataaccaaactaatccccttagaaaaaaatccccctttccccagttgggttaataataaaaaggccccacccaatcccccttccaaacaatttcccaccctaattgtcaattggcccccccc

SEQ ID NO: 83378 - DNA, 126 bp, Zea mays
  Clone ID: LIB3114-052-P1-K1-C5
attcccggttcgacccactcgtttctaactagttatagatcgtgagcggtcgctctatagtattcaagcttacgtacacgtgcatgcgagcggatagcttttctatagggtcatctaaatttaatt

SEQ ID NO: 83379 - DNA, 138 bp, Zea mays
  Clone ID: LIB3114-052-P1-K1-C8
ttcccggtcacccacctccgactagtttagatcgtatgattggccttcatcctttatgagaataacggtccaaaaggcggcaatcctttaggtagcacagtatttccaaggacagtcatcctcactggtaatatctca

SEQ ID NO: 83380 - DNA, 302 bp, Zea mays
  unsure at all n locations
  Clone ID: LIB3114-052-P1-K1-D1
aggctgaatgcacccactgaggtggagcactccacgaaagtgggagctggtacctgcctccttgtacagatgtatctcatggattctacggcggtcgggctgcctgaactgctgtttgtaccctagtaggggtttagactgcgcgaccacacgcagagctgnattgtaggggtgtagggtgtcttctatcaaccgatcgtagttttacattgtactgttagtatgtgcaacacncctcgattccattgctgaattcctcctggcctcattagactacagccagctgcttctgatgtcttgcc

SEQ ID NO: 83381 - DNA, 181 bp, Zea mays
  unsure at all n locations
  Clone ID: LIB3114-052-P1-K1-D2
tggaggtactgatgtgtgggcccatcctggcttcggccgagttatcttatctatctatagtatcgtgttaccgttcgcttctgtcaccgtgtanaagtacgttctacctttggattaagtgttggtaccctgttgttcgctttggttgctcccccatatgaaacgagaagagagaatattg

SEQ ID NO: 83382 - DNA, 402 bp, Zea mays
  unsure at all n locations
  Clone ID: LIB3114-052-P1-K1-D7
ggtccgntccgnaattcccnnntcgacccacncttccnntaaggtatgattataactacttgctggactattgcgacgagaaggacggcctgaagcgtgcggccaggctgaaagatccgtcgagcttgcggaccctggacctgtggactgacgcacccggcatgcagctgtacactgccaactacgtggatggcatcggaggcaaggcgggcgctgtctacgctaagcatgctggagtgtgcttggaaacccatgggttctggaatgccatgcaccagtctgagttttcctctgtggttgtttggtccggtgagaagtataagcatactatgctgtttgagttctcgggatgtgaatatgtgctggacagcatatattgttgtaaaacatgttgaatgaatt

SEQ ID NO: 83383 - DNA, 489 bp, Zea mays
  unsure at all n locations
  Clone ID: LIB3114-052-P1-K1-E4
gcggctccggtccggaattcccggttcgacccacgcgttccttnaacaaggttggtggattcctgcagcggatggacctgtgccgcaagtacgcctttgggaagatgctcgtgataggctctgagccacccttcaagctgaagggcctttggctcttccgtggccaggatgttcccaagtttgtaatggacgaggtctatgacatggagctctacgagtggaccaaggtggacatctctgatgaggcccanaaggagcgtgtcaatgcgatgattgaggaccaggagccctttgagggcgaggccttgcttgacgcgaaatgcttcaagtgagtgtgcttgcctggagacagaactgtttagcccttgaatttgcctatggaagagtttgcccttttactagtgtcgatgttgatctggtataccttgctatgaactggttaaagtgtgtgctggtttgggattttttgtgcatcttgtgatacctcaa

SEQ ID NO: 83384 - DNA, 405 bp, Zea mays
  unsure at all n locations
  Clone ID: LIB3114-052-P1-K1-E7
cgtaattcccggatcgacccactcctccttgtcctccgtccttgatctatctgcatcttgatctctctctgctgctgctgcatgctcgacatgtgcttctgagttcgtcgtcaggggctcagggcacggggatggcgcgcctagagtccagaccgatctccatcatgcagtcaggcgaaaaacaatgcatggagctgttctttttttttccttcctttctgaatcatgacgatgatacatctttgaatacgtatacatcctgagtatgctagtcccgngctncgcatggaaacttcactagctaccccagcagggataatgttctctggcgttcatgcgcgtgtgttctcgacctctgaagtctgaaatgaaaacatctgcgatcggattcttataaaaataaat

SEQ ID NO: 83385 - DNA, 375 bp, Zea mays
  Clone ID: LIB3114-052-P1-K1-F10
atccggtatgttcttcagccccgacacggacacactttatgttggaatctcggacaggacatatggcagcctacttcagtttggccgcctctacaattattcatacctcgactcactactatgaaggtcaaagaaaatatgtgttttccctcggcttataatcaacccagattaggcatcccaaatgaagtttaattgagcctggtattcctactaaagaatcctgtaccctggagtatgtgatacataaaaaaccagtattttatagacaccagtagtctgctaccctgctttcagataggtatataaggtgtcaggattcaaatcgcaagttagatctcaattcgttatagcacaagatgaattcataaagtc

SEQ ID NO: 83386 - DNA, 169 bp, Zea mays
  Clone ID: LIB3114-052-P1-K1-F7
gattaggagaaggctgatagggtgcaccacactatagcgatgctcacagacacgggtgtgcggagggaacaagctcttagagtgctaccgaaaagaatttcacaggccggtatcgaacagaaggccaaccggaaaaaaccttagcgtgctcgactaataatgcctggat

SEQ ID NO: 83387 - DNA, 97 bp, Zea mays
  Clone ID: LIB3114-052-P1-K1-G3
tctagatgtatccattgcttacttacgcttctcatgcggacggggtagctctatcaatagggtcactcaaaattcaagtcactcggcgcgttgttaa

SEQ ID NO: 83388 - DNA, 234 bp, Zea mays
  unsure at all n locations
  Clone ID: LIB3114-052-P1-K1-G6
taccctgctagattggagtctgcgacatgtgtctcacaatagatgaatgatcagaggtgggttttggtgtatgcgcctctcgcggatgatgacgcagtgtgggacagtgaaaacagccttttcactcgccctgaagatgatctccgcgagtgatcgacagatggcgccgcctacggagatgacgtttctttcacctcccattcttttttaatatatcataggcgtatgatanaa

SEQ ID NO: 83389 - DNA, 156 bp, Zea mays
  unsure at all n locations
  Clone ID: LIB3114-052-P1-K1-G7
ttnttttttttttttgggttattttttggagatgccgcttgttagggtagctagctgctcacatgatgcaaagaccatataaggtttgctttccatcctgtttgtttctgtgcagacaggaggagaggggacatcttacatgggggctaatattga

SEQ ID NO: 83390 - DNA, 51 bp, Zea mays
  Clone ID: LIB3114-052-P1-K1-H6
cggtcccggtccggatatccccgtttcgacccacacccactcaatctcatt

SEQ ID NO: 83391 - DNA, 368 bp, Zea mays
  unsure at all n locations
  Clone ID: LIB3114-053-P1-K1-A1
cctgcagtaccggtccgnaattcccgggtcgagccacgcgtccgcccacgcgtccgaaaaaaaaaaaaaaaaaaataaaaaaaaaaaaaaaaaaaaaaaaaatagaaaaagaagtaaaaaaaaatacattaaaaaaaaaaaaaaaataaaaataaaagaaaaaaattataaataaaaaaaaaaaaaaaaggggggggccgttttaagggttcaaagtttataaacccgtctttgcaaactaataatttttttataggggaccttaaattaatttacctgcccgttttttaaaaactttagatatggaaaaacctttggtttaccaaattaaaaggcttttaagaaaatcccctttttgcagggtgggg

SEQ ID NO: 83392 - DNA, 244 bp, Zea mays
  Clone ID: LIB3114-053-P1-K1-A11
tctagacgatccaagcttaccaaccctaccttggcacgcatgcgatcttatatatcgtctatataagatacactacactgagtcgactggctacaacgtttacaactgggaaactgctaacaccacccaacttaataacctagtagcacatccccctatccccatttggcctgatagcgaaaaagccaggacggatcgacctttcgaacttttgaacagcctcaaaggctaaagggacactgcg

SEQ ID NO: 83393 - DNA, 117 bp, Zea mays
  Clone ID: LIB3114-053-P1-K1-A2
cgcacgcgaggattatgttctttatcttttattttctttagaccacacacctggggcgggctggcgggaaccatatttggcgggtgccccaactcctgtacgtccataggcagctag

SEQ ID NO: 83394 - DNA, 226 bp, Zea mays
  Clone ID: LIB3114-053-P1-K1-A3
atgaactacctggtgtccgagtatcagcagtaccaggatgccactggcgaggatgaggagtacgaggaggaggaggaagaagaggaagagacctaagtcattctccgcagtgcttggtacagatatgatattccttgtatcgctgttagtactcgtcagtttgaggttcgtgtggtgatgcttgctaggtactagatgggtggtattgcttatgaatgcgatgatg

SEQ ID NO: 83395 - DNA, 219 bp, Zea mays
  Clone ID: LIB3114-053-P1-K1-A5
tttttgatacctcccgtattgtcgaacatccccaagtgcgtacgcgtgcgtgtgagagtgatatcgagcgcccgccgtgttgtgcgcgcgtacgtatgtatgcgctcgtgtgatgcacgaataagcgtggctacttaatctatcgtatggatacgtgtgtgtatgcatgagcttgtgtatgatcatggtacaaggaccgaaataatgtattcatctctg

SEQ ID NO: 83396 - DNA, 124 bp, Zea mays
  Clone ID: LIB3114-053-P1-K1-A7
tgcagtaccgttccgtattgacgtatctatccactcgattcgaaaaaattatatatattacaaaaaataaaaattaaaaaaataataaaatatcataaaacaaaaatattatataaaaccaaat

SEQ ID NO: 83397 - DNA, 262 bp, Zea mays
  Clone ID: LIB3114-053-P1-K1-B1
gtggtgtgcgcgtgtcttgagatgtgattccttccttctttggttagttgctgctgctcctgctggtgtagtactggtgtatccagtccttttaatttcttgattagtttgctcggctgaagaaatcaggacgcgtgcctggtgtcgctcctcagctccatgtacttgtacaaccgttcctccctgcagctgctgccccttctctcttttttgtttaccttgggttggagggttgctaaattcggtggttgtctctttttta

SEQ ID NO: 83398 - DNA, 74 bp, Zea mays
  Clone ID: LIB3114-053-P1-K1-B5
ttctatatgatccttgctaacgtacgcattcaggcgacgtgatatctcttctatagtgtgacctaaattcaatt

SEQ ID NO: 83399 - DNA, 412 bp, Zea mays
  Clone ID: LIB3114-053-P1-K1-B6
cgggccggaattcccgggtcgacgccacgcgtccgaaaaaaaaaaaaaaaaaaaaaaaaaaaaaaaaaaaaaaaaaaaaaaaaaaaaaaaaaaaaaggaaaaaaaaaaaaaaaaaaaaaaaaaaaaaaaaaaaaaaaaaaaaaaaaaaaaaaaaaaaaaaaaaaagggggcaaaaattaggggggccaatttaaaagacctcaatttttcaacccaaaacatttaaaaaaaactcactaaaaaaaaataaaataacgaaaaattcaaaacggtttaaaaaaaaaacccctagatgaacaaaattaatgcgcctaaattaaaaaactttataaaaaacctgctttaataactatgaggcataaacaaaaacgcttgaacaacaagggaaaaaaaaaaatggagccccgaaaaa

SEQ ID NO: 83400 - DNA, 241 bp, Zea mays
  Clone ID: LIB3114-053-P1-K1-B9
agtaccggtccggtaattgccgggcgcacccacgcttaattgaataaaatattacatattcaacttatctattccctatcacaaaacaataggggttgctatcttggggggcgtgttgtgtcttatacactatttcatctttatcttgtaaattgttccaccagttcatattatgtataccctccgattgtgctatgaaatcactttttttgccaaaaaaattaattaactaataaatata

SEQ ID NO: 83401 - DNA, 182 bp, Zea mays
  Clone ID: LIB3114-053-P1-K1-C1
tgatcgattgaataagagggtggatattgaactgatgtaatgcctctgccgaaacaatatgtctccctatcttgttaggcgtgttgtgtgttgtgcacgatttcagctgtagcttgtaaattgtacgacccgttgatgtaatgtataccctgcgtttgtgctgagaaatcacttcttttgcc

SEQ ID NO: 83402 - DNA, 200 bp, Zea mays
  Clone ID: LIB3114-053-P1-K1-C10
attcccgtcgcgagccactcttacgattaacctcaatatcaaccgtttttctactttcccaagcacacctacttccgggaccgggatatatccagcacggcgatgcctacaatcaactaattatgcctcattcgcttttaaaacaagtatcatattccctttaagcccaatattactccatttgctcgttcactaactta

SEQ ID NO: 83403 - DNA, 414 bp, Zea mays
  Clone ID: LIB3114-053-P1-K1-C11
aagaaaaggagggtataaaaggaaaaaaactggaagctgtgattcttttccttttctacatttattattattcatataagatgttccccctttcgtgttaagttattggttcgagtacagagggataataaactcataaacctgtatggaacgaccaggtttatttcatggaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaggggatccaagtttacttccccgtgcttgcaacgtaatactttttttatggggccccctaaattaaattcccgggccggggtttaacaacgtcgggacggggaaacccctggcgttcccc

SEQ ID NO: 83404 - DNA, 317 bp, Zea mays
  unsure at all n locations
  Clone ID: LIB3114-053-P1-K1-C12
aagaaaaggagggtataaaaggaaaaaaactggaagctgtgattcttttccttgtctacgtgtattattattcatataagatgttccccctttcgtgttaagttattggttcgagtacagagggataataaactcataaacctgtatggaacgaccaggtttatttcatggtaaaataaataaaaatttaaaaaatttaaaatattaaaaaataaaaaaaatataaaaaaaacaaaagatcttttggtggagnggatgagaaaaaaaaaaaagaaaaaaagggggggccgctttaaaggatccaagttttcgtcccc

SEQ ID NO: 83405 - DNA, 258 bp, Zea mays
  Clone ID: LIB3114-053-P1-K1-C5
attccatttcttcccacgcgtgctatcatatatattaacataatctttctctctaatattatccaatcttacttacgctttcatgccacggggtatctttattatagggtcacctaatttctattcactttcctttattttacaacttccttacttttaaaaccctttcttttccctacttattctccttccatcacatccccctttcaccaacctaaataatattttaatactccctcatcctatcaccctttccaa

SEQ ID NO: 83406 - DNA, 425 bp, Zea mays
  unsure at all n locations
  Clone ID: LIB3114-053-P1-K1-C6
aaaaaaaaaaaaaaaaaaaaaaaaaaaaaaaaaaaaaaaaaaaaaaaaaaaaaaaaaaaaaagaaaaagggaaaaaaaaatatatttaaaaaaccaaacaaatcttctcatccactctccctttatctttttttctttctttctccctttttttatctctctcctacttttctttccctccctttcccctttttccccccttttttattcccctctttttttccccccccctccccctcctctttttttttcttttttcttcctcctcctttttcctctcccccccctttttcccaactttttccccctcatatccctttcttttccctcttttttttcttnttctttttcccctcttttctcctttttcttatnnnntatatttcccctcttttttccccccccccccttctcttttccttttt

SEQ ID NO: 83407 - DNA, 170 bp, Zea mays
  Clone ID: LIB3114-053-P1-K1-C8
ataaaacgcaacatgtagcgtcttgcaactgtcgcaagcacagctactactgctactgattaaataaacaggactgcaatgatagtaataaactatttaggcctcgttcgttttgaaaacaggcatgtttttagttctgggccggatggagtgaatcctgctggttcact

SEQ ID NO: 83408 - DNA, 196 bp, Zea mays
  Clone ID: LIB3114-053-P1-K1-C9
ataaaacgcacatgtagcgttttgcaactgtcgcacgtcacagatactactgttactggtgtatatatacagtactgcaatgattaaaataaactatttaggcctcgttcgacatgaaaacaggcatgtatatagttctgggccggatggaatgaatcctgctggttctctaaatttaaacaaatgacataataac

SEQ ID NO: 83409 - DNA, 215 bp, Zea mays
  unsure at all n locations
  Clone ID: LIB3114-053-P1-K1-D1
cgaannccgggtcgacccacgcgggcgtgtgatctatcctcccgctaccaagccactttttattatggcagcgtctctccaagccgctggggcgctgatgccgggcaagatcggcagccgggccttctcctcgcgaccgtcttctcacgtcgcccgggcgtacggcgtcgacgctggcgcctggatcacctgctccctgcagtactacatcaagg

SEQ ID NO: 83410 - DNA, 242 bp, Zea mays
  unsure at all n locations
  Clone ID: LIB3114-053-P1-K1-D10
ccgcgcggccaagttatcctgttggctaccgggatgtttaccctaggccagagggtttatcttcgttcgtgtcgtgtttgttgttgcccatctgtgtttttgattgcaagggcgctctgtgtcagttgttagtgctgtgttcatcctcggtttcagcagacccatgcatcaaacagcatggactgcggatcgatggatgctgttacccccgtgggggtgnattgtaaggttaatcttaaggg

SEQ ID NO: 83411 - DNA, 251 bp, Zea mays
  Clone ID: LIB3114-053-P1-K1-D12
cgagctttgggtggtgtcggaaggcagggtgaccccgttctcgggcactttcaaggactacaagaagatgctcaagtaacaaaaacatgtattatcgaccatagcctatatatctatatgcttgctattatgttgtaaaaaaaaaaaaaaaaaaaaaaagggcgggcggttttaaggatccaaggttacctacccgtgcatgccacgtcataacttttttataggggtacctaaatttaattcaatgggcc

SEQ ID NO: 83412 - DNA, 65 bp, Zea mays
  Clone ID: LIB3114-053-P1-K1-D2
atccaagcttacgaacgcatacatgcgacggggtagctcttctatgggggcacctaaattcaatt

SEQ ID NO: 83413 - DNA, 441 bp, Zea mays
  Clone ID: LIB3114-053-P1-K1-D4
ggaattcccggggggacgcgggcggccggaaggagttcagctacagcaagatcctcaaagatctcaagaaagagttctgctgcaatggtgcaggggtccaggacccagaacttggacaggtcattcagctccagggtgatcagaggaagaacgtctcgaatttcctcgtccaggccggcattgtgaagaaggagcacatcaagattcatggtttctgagcaaccgccgggtccatagcaaaccaaccctgcatgcagggccagcttattatatataatatctgaggtggagcatatctatctggctgtgtactgcaagcaggcctagtacgccgcctgcgcgttcctcctattacacatataggcccctccctgcgtggatgcttgtgaccggcgtgtcgaaccttgtactacgaggctccatcgaacatcgatggcttgc

SEQ ID NO: 83414 - DNA, 230 bp, Zea mays
  Clone ID: LIB3114-053-P1-K1-D5
ctacatcctcatagttcttacctatgaattctaatccactgggacaggggtccatgacccagagacttggccagttcattcatatccagggtgatcagaggaagaacgtctcgaatttcctcgtccaggccggcattgggaataaggatcacatcaagattcatggtttctgagcaaccggcgtgtccatagcaaaccaaccctgcatgcagggccagcttattatatat

SEQ ID NO: 83415 - DNA, 312 bp, Zea mays
  unsure at all n locations
  Clone ID: LIB3114-053-P1-K1-E1
gcgtgcgatctaattcattgagtgagcacaagcagagcattattttttcggagcctctccatctcgctttcgggggctggtgtgtcgacctcggtgctagccatggccgtgctgaggagaggttcggccgtggccttggcggctgcggcgatgtttgccgggatggcttctgcggtcgtgtacgaggtggacgacaaggtcgggtggaccattatgggcaaccccaactacggagcctgggccgtctccaagaaggtcgnatggggaaacacccttgtgttcacctacatcaagcagttccacaacgtgatc

SEQ ID NO: 83416 - DNA, 242 bp, Zea mays
  unsure at all n locations
  Clone ID: LIB3114-053-P1-K1-E10
ccgntccgtaattcccgggtcgacccactcgtcctaaaaaaattcaaaatataataatataaaaaaaattaacaaaaataaaattaacaggctagcgggacactttcattacgcgatttaagctcttctataatcctctcctaaattcaaatcactttaccttcattttacaactcttttactttttattccctttctctacccaacttaatcctttttgctttcattatcctctttcctaa

SEQ ID NO: 83417 - DNA, 389 bp, Zea mays
  Clone ID: LIB3114-053-P1-K1-E11
aaaaaaaaaaaaatataaaaaactaaataaaaacaaaaggaaaaaaaaaaaaaggggggggggggaaaagggggggggggggggggctctatataacccactctctcgatctctagcttgtgccgtcatattcttttctatggggccccctaaattcaatgcgctggccgtctttttacaactgggcggctgggaattccctggggtgtcccaacttaatggcttggcacacattccccttgtgccaagggggggataaggggagagggccaggccgatcgcccttttcaagtgtggggcatcctgggggggttatggttcccccccttaggcgggcccaaggggggggggggggggggggggccccagggggagttggggggggccct

SEQ ID NO: 83418 - DNA, 87 bp, Zea mays
  Clone ID: LIB3114-053-P1-K1-E12
accggtccggaattcccgggtcgacccactcttcctaaaaaaaaataattaataaaacattaaacctaaaattaaaaaaacaataaa

SEQ ID NO: 83419 - DNA, 448 bp, Zea mays
  unsure at all n locations
  Clone ID: LIB3114-053-P1-K1-E6
ccgggccggaattcccgggtcgggccacgcgtccgcaaccgtggcggcggctacggcaactccgacgggaactggaggaactgagcggtgggggccgcgcggccaagttatcctgttcgctaccgtgatgtttaccctagtccagagggtttatcttcgttcgtgtcgtgtttggtggtgcccatctgtgtttttgattggaagggcgctctgtgtcagttggtagtgctgggttcatcctcggtttcagcagacccatgcatcaaacagcatggactggggatcgatggatgctggtacccccgtcaggctttattctaaggtaatcttaagggaaaaatggtgcttcttggtgctgcgnaaaaaaaaaaaaagaaaaggtggtggggggggggtaantatgtggaaaggggggcggcggtctagaggatccaaggttacgtacgcg

SEQ ID NO: 83420 - DNA, 426 bp, Zea mays
  unsure at all n locations
  Clone ID: LIB3114-053-P1-K1-E7
tggaattcccggcncgacccacgcgttcgaaaaaaatataaaagtcttctgaaagttgcattctctccctctcggcaaatttggtgtgggtgaggcgcgcgaggtaaaccaaggttttgctcatggctcgtactaagcagaccgctcgtaagtccactggaggaaaggctccaaggaagcagctagccaccaaggctgcccgtaagtctgctcccactactggaggagtgaagaagcctcaccgttaccgtcctggaactgttgctcttcgtgtggcccgtatgttccagaagagcacggagttgctcatcaggaagcttccattccagaggcttgatagggagattgctcattacttcaagactgacattaagtgtgagagccattcggtgctattgtttatcgaggctgcagaggcctacctgg

SEQ ID NO: 83421 - DNA, 196 bp, Zea mays
  unsure at all n locations
  Clone ID: LIB3114-053-P1-K1-E8
ccggtccggaattcccgggtcgagccactcnttctcccacgcttccgtgtgaggctgctgttgtctaggtggtttgttagggccttcaccgggtgttctaccgtgcgccctgtgtaggttttgggtccggttttccttaaaactggatcaattctattcttcttaattgagaggcagagctcctgccattatgttc

SEQ ID NO: 83422 - DNA, 249 bp, Zea mays
  Clone ID: LIB3114-053-P1-K1-F1
gggcgctcaccggctgcacgcctgcatgggccgggcagctccgctgcgccacgggcgactgcggcgggcggctccagtgcgggggcctcggcggcgcggtgcccgccacgctggctcaggtctccctccaccacggcggcgacgaccagtcgacgcacggggagagcgtggtggacggcgtaaacgtgggactgtaggttaccccgcacgagggccgcaacatctgtcccgtcctcgactgccggaagg

SEQ ID NO: 83423 - DNA, 368 bp, Zea mays
  Clone ID: LIB3114-053-P1-K1-F10
acacgcatcacacaggaggtggggtatggataaaattatagatggatggtgacacaacacagcagggcacatggctagcctgctagcgtgcggcacccacacaacacaacacactggtcgccagaagcgccccaggaggccaggggaggacacgacgccgccatcagccatcatcatcatctcagactcagagcatgccatggcacccaactgactgactgactcgaaacacacacagggacgccgctatactttattaagctttataattagctagcttcctccggccggcctggagggtggagcacctagctcacttggcggagtggcaggggtcgcactggcagttgccggcgcacttgcacccg

SEQ ID NO: 83424 - DNA, 104 bp, Zea mays
  Clone ID: LIB3114-053-P1-K1-F11
tataggatccaagttaacgtacacctacatgcaacatcataactctactatagtttaacctaaatacaattcaatggaagacattataaaaacataagattgaa

SEQ ID NO: 83425 - DNA, 145 bp, Zea mays
  unsure at all n locations
  Clone ID: LIB3114-053-P1-K1-F2
cctgcagnaccggnccggaattcccggggcgacgccacgcgttcggtctaattatagattgcgagcgggcgttctagaggatccaaccttacatacgcgtgcatgggacgggatagctcttgtatagtggcacctaaattcaatt

SEQ ID NO: 83426 - DNA, 183 bp, Zea mays
  Clone ID: LIB3114-053-P1-K1-F3
taccggtccggaattcccgtagcgacgccacgcgttcgtaaaaaaaattttaaaagtataacagacaaaaaaattaatataaaaataaaataatatataaatggggttaggttaaactttatttggggccacctatttataaataaatgtcattactttattaataaattatttatataaaaa

SEQ ID NO: 83427 - DNA, 189 bp, Zea mays
  unsure at all n locations
  Clone ID: LIB3114-053-P1-K1-F4
ccggtccgnaattcccgggtggagccaggcgtgcgtaaaaaaattttaaacataacctgcgattctttaaatcttactgccaatttggtttgtacatgtgggggtggctagagaaaagggaggatgttaaagttttctaaaaaaaaaaataaattaaagattttttatattttaaaaaaatatataatt

SEQ ID NO: 83428 - DNA, 226 bp, Zea mays
  Clone ID: LIB3114-053-P1-K1-F5
tccggaattcccgtgtcgacgccacgcgggcggtaacatccaatgtggaacttttgacaagcatgggaatcttgttttattatatacatgtgacatgggcttccctctgcttatgtacaatgtttgaaagttaaaaccaaatgtttcagtgtggcattatgacttgttttaaacatcaattcatggctttaaactggtttgttcagagtcattttatcaaaaatat

SEQ ID NO: 83429 - DNA, 340 bp, Zea mays
  Clone ID: LIB3114-053-P1-K1-F6
gaaagaaaaggaaagctccaatctaacccacattcattcggatccactcaatataacgacgaacacaaccggccatactcgaccccaatgacgacgcaacacacccagccagacggccttcgcaaattcctcttgtccggccaaaggtctctggcattccaatactacagcagaaaagtcttcgggctataagcaaactgaaacggggaacagagagagagactagggaaaacgctaacagctagccagctgctctccagcagcgacgagatggagccgcaacgctctagggcgccatgcctgcccagttccacagcctgccttggttggtcaccaggac

SEQ ID NO: 83430 - DNA, 126 bp, Zea mays
  Clone ID: LIB3114-053-P1-K1-F7
aagaatgatctgtacagatgtatatcagaggttatgtaaattatccccctgatgtagggggccatatcaacttacagtgagatcttgtaggtgttgaatgtaatgtatcattctttaattcccccc

SEQ ID NO: 83431 - DNA, 448 bp, Zea mays
  unsure at all n locations
  Clone ID: LIB3114-053-P1-K1-G1
ccggnccggaattcccgtctgcgacgccacgcgtccggtttattcataagagagttcagtgactccttcttttgtcaccttattggagggtggtaagaggaagagagggcggccgaagcgtgtgcctgatatttcagtgactccttcaagtcattctggcctttcagtagatgttgacagtggtgacacatcaaaacgtggccggcctaaaaaaattgacacaagcctgttgcacctgccatctttgttttcagacgatcccagggagtccgcagataatgtgcttatgatgtttgatgcactgcgacgacggctcgtgcagttggatgaggtgaagcaagtagcaaagcagcagcaaaacttgaatgctgctagtatcatgatgaacgctgagcttcggctcagtaagaacaagangattggagaggttccaggtgtcgaggttggt

SEQ ID NO: 83432 - DNA, 411 bp, Zea mays
  unsure at all n locations
  Clone ID: LIB3114-053-P1-K1-G11
aggcggcggctactgcggtggcgggctccgtgatggcggtggcggctactgcggtggcggcggctacggtggcggcggcggctacggtggtggtggcggctgctacagcggtggcaaccgtggcggcggctacggcaactccgacgggaactggaggaactgagcggtggggcccgcgcggccaagttatcctgttcgctaccgtgatgtttaccctagtccagagggttaatcttcgttcgaattgtgttcggtgttgcccatctgtgtttttgattgcaaggtcgctctgcgtcagttgttagtgctgtgttcatcctcggtttcaacaaacctatgcatgaaacatgatggactgccgatcgagatgataatgagagcccccncaggctttattctaagctaatctta

SEQ ID NO: 83433 - DNA, 279 bp, Zea mays
  Clone ID: LIB3114-053-P1-K1-G4
acccatccccaattccccatgcgacccacgcgtcctcacacacttttaaactagatctacatctctatctgcccctctatagcatacacactcacgcaccggggcatgcgacgtattagctcacctataatgacaccaaaagccaattcactaccccgcgtttaataacatcaccactgcgaaacccatcttattaccctacgtaaacaccttgctttacacacctgtctcgacagctgaaaaaacatcaccgatggccttacccatcagcctcccaaa

SEQ ID NO: 83434 - DNA, 125 bp, Zea mays
  Clone ID: LIB3114-053-P1-K1-G7
atataaacacaatacgatcgtccgctttcctttctcctggttcttgttgatggggggggggctgcgcgcataatggtctagagccttcccctctttcccaccaacctgtactaccacaggtgctc

SEQ ID NO: 83435 - DNA, 350 bp, Zea mays
  unsure at all n locations
  Clone ID: LIB3114-053-P1-K1-H7
tggttttgggtgtatcgactccagagcatgtgaaacagatcgtgggctggggagcggacggtgtgattgttggcagtgcgattgtgaagcatttgtgtgaggctgctactcctgaagagggtctggaaaggctcgaggagtacgccaggagtatgaaggctgctatgccgtgagctgatctcactcgtagtgacaggcaaggtaagtagaacatggttttagcaatattctgtgcatggggttggcatccataactcatctagtgctgtacggcncagtataaggtggtgagaaggaannctaggtttgactatattatgaaaggggtataaactgagttagtgcgacat

SEQ ID NO: 83436 - DNA, 89 bp, Zea mays
  Clone ID: LIB3114-058-P1-K1-A11
ttctagagggatcccaagcttaacgtccccgtgctggcaacgtattacttttttattggggcaacttaattcaatttaatgggcggtgg

SEQ ID NO: 83437 - DNA, 241 bp, Zea mays
  unsure at all n locations
  Clone ID: LIB3114-058-P1-K1-A2
cacgatcagattctacattcaggtatttattgtttaaaccatttgaccagtaagtttgcggctgcttctcatgaaacatttcctatangctttacgaaacatctgtagatgacgctttgtttcttaacatgtccagcgaagctttctttcttaacatgttgctattgtgtccagcgaagatgcatgctatctcctgctaatgttgctgccgaagaaatgaactttttacttttatgtagag

SEQ ID NO: 83438 - DNA, 194 bp, Zea mays
  unsure at all n locations
  Clone ID: LIB3114-058-P1-K1-A4
aaaaaaaaaaaaaaaaaaaaaaaaaaaaaaaaaaaaaaaaaaaaatacanaaaaaaaaatgggaagggaataagggggggggcggtctaaaggaaacaagcttaaatacccgtgctttcaacatgttatatcttgtaaaaagccccctatataaaaactactggccgttgttttacaactctcataatggaaaa

SEQ ID NO: 83439 - DNA, 98 bp, Zea mays
  Clone ID: LIB3114-058-P1-K1-B1
gaaaaaagttcgggcctatctcgtgatagagaggcctttatatatacgtgaaaaaggagacatactcgccatccgtcatgggtgttgtgtattaccaa

SEQ ID NO: 83440 - DNA, 196 bp, Zea mays
  Clone ID: LIB3114-058-P1-K1-B10
ctagtttctcttcctcttgtgttccccgtttcagtttgcttatagccccgaagactcttttctcccgtagtgtcggaatgccagggtctgtccctgtgggtgtgttgcgtaactgggatccgagtataccctgctgtgttcgtcgttacattgaatggatctgaatgaaagtgggttagattggagcttttcttcc

SEQ ID NO: 83441 - DNA, 104 bp, Zea mays
  Clone ID: LIB3114-058-P1-K1-B11
aaataaaaaaaaatataaaagcacgcacactaaaaaaaaaaacaaactaacattcgggtgggcgaaataaaatagctgttatatagtgtcacctaaattcaatt

SEQ ID NO: 83442 - DNA, 62 bp, Zea mays
  Clone ID: LIB3114-058-P1-K1-B12
aaaaaaaaaaaaaaaaaaaaaaaaaaaaaaaaaaaaaaaaaaaaaaaaaaaaaaggggagag

SEQ ID NO: 83443 - DNA, 233 bp, Zea mays
  Clone ID: LIB3114-058-P1-K1-B6
cctgcttggcttttataggaagaatttgaggaagccacttatgatatactgatgatgtgggtgtactcttgtttgcttgcactcttcgaagcaagcacctcttgctgttgacgtagctattgcactctggacatccgttggaacaacctctctcctccctacagtctacagtgtgtgatggacgaattccatgccgttgggtttgcattatcgatcaatgcatggattaacgt

SEQ ID NO: 83444 - DNA, 241 bp, Zea mays
  unsure at all n locations
  Clone ID: LIB3114-058-P1-K1-B7
aatcctagtttgttattaaatatgaaagaacgaagcaatgaatactagtgaatctttgcttccattcgtttctttttctttttctttttttttttgcattacatgatgtaaccagcatacgctggatgaaatgcttgttttttcacagatttgatctgatctgatccgatccagtgtggtctggcacaatgtaatgtaaaggtgggagggaagcagaaaccaaggaatacattttgcantc

SEQ ID NO: 83445 - DNA, 203 bp, Zea mays
  unsure at all n locations
  Clone ID: LIB3114-058-P1-K1-B8
tgtagttttaaaatatgtggttcctgcctgtttggcagtgcttatgcggttttggaggccagttcatatcaaatatttcacatcaattaaatctatcctcgctgtcaaaaaaaaagaagagactgggaaaaaccaanacaaaacccaacaaaaaaagccaagcaaaacatccaaaaggggggggcgctctagaggaaccaagc

SEQ ID NO: 83446 - DNA, 233 bp, Zea mays
  unsure at all n locations
  Clone ID: LIB3114-058-P1-K1-B9
ctaataaatatatttcgctaatgcgatgcatttaaaaaaacttacacaatattggggggcaatacatataaaatgggtgcaccttaattaaaaactaccctcgctatcaaaaaacaatacaaaaaaatcataaaaaccataaacaaaaacaaaaaaaaaaaaaaagggggcgccccttttaagggtccaaatttaacttcccccncccctccccttaccgctttttttttgcg

SEQ ID NO: 83447 - DNA, 66 bp, Zea mays
  Clone ID: LIB3114-058-P1-K1-C11
aaaaaaataaaattataaaaaaaaaaaaaaaaaaaaaaaaaaaaaaaaaaaaaaaaaaaggagaaa

SEQ ID NO: 83448 - DNA, 104 bp, Zea mays
  unsure at all n locations
  Clone ID: LIB3114-058-P1-K1-C3
aaaaataatttactaatttatgattactctaaaaaaaaaaaaaaaaaaaaaanataaaaaggggggggggttctaaaagaaagcaagaaagaaaaaaggggggc

SEQ ID NO: 83449 - DNA, 240 bp, Zea mays
  Clone ID: LIB3114-058-P1-K1-C4
actgattgacttttataggaagaaattgaggaaaccaacttaagatctactgatgatgggggtgggctaaagttgtggttgggctctaggaagcaagcacctatatgctgttgacgtaaactattgcactctggacattcggtggaacaaacctatctactggctacagtttacagtgtgcgatggactgaattccatgccggtggcattgcattattgatcaaggcatggattaacgtt

SEQ ID NO: 83450 - DNA, 292 bp, Zea mays
  Clone ID: LIB3114-058-P1-K1-C5
gttaagtcgtcctgcgccgataattcttggtggtcaccagataaagagtcattcctggtgtcggtgttgattgctgttggttggtcgggaaatgactgggtgaaccgaggggcgaagtgggaggggggttgtgtcgtttaattttggatgccactattgtgcatgtatagccccgtgtgcttgtgctaccctgatccgtgttgctactcctatgtcagtagatgttacgtactacgttttgctctaaaaaaaaaatgggttttatttctataatgtttttcctttttttttt

SEQ ID NO: 83451 - DNA, 422 bp, Zea mays
  Clone ID: LIB3114-058-P1-K1-C9
ggaaaccttgcaggatatccttggggaaaacaaaactattttggttgaacagaagattgactacagcatcatgggaggattagtgattgaattcgggcagaaggtgcttgatatctcaatcaggaacagggcgaagcaaatggaggcgttcttgaggcaaccacttgacttctaacagccttttggataaaagaagcatcatcggaatgcagaggctgtcctgttgaaggttttcctgtgtctgcaattttaatctggccttttgaataaaatgtttcctctaacaagtgaaaggcactgtttttattgtctcgtgggccacaaatgcctgctgaacaatttatgttcatttcttcttttcttaaaaaagccatcactaaaaacatgaaagatgcatgccatggaaaggtttttgaagtcac

SEQ ID NO: 83452 - DNA, 66 bp, Zea mays
  Clone ID: LIB3114-058-P1-K1-D1
agacagcaggacggtgttcatgttagtcgatgtgctggttatccttttaaaaaaaaaggagggggg

SEQ ID NO: 83453 - DNA, 352 bp, Zea mays
  Clone ID: LIB3114-058-P1-K1-D2
cggaagttccaggccccattgcagcactacactgcgctaatggaccttcaggactattctgagaatggaactgtaaccgtggtatatcgagtgatacttaaaggaactgatggagaggcatatagagatgccacgggcacaacacagttccatgaggggcgcagggaagatgctgttgcagccgcagaggaagctgcattcagcaaagcttgcgcatggttcggttttggcctgtatctgtaccaccaggatgaatctcattacgacgaccacttccattgaggctcaatctgcaaaagagttgatcataagttgtaacatgcgttggatatgcccctagaaaacttcgtat

SEQ ID NO: 83454 - DNA, 365 bp, Zea mays
  unsure at all n locations
  Clone ID: LIB3114-058-P1-K1-D4
aggtaccgaattcccgggtcgacgccacgcgtccggaaccccgacctaaaccgggagcccaccccggacacctcggacgacnagtaaagcgggggtagggtttgatgccggtcttcgtgctcctcggtctaccagtccctactccctagctacatagctgtagcagatagagcaagcaaccaggtggacccaggaggccaggacacacggaggggcgcgggaggtcccggtcgcagcgcaaggtgttcgatgggctgcggatgagctccatccaataatggagtcgcgacgtcgacgtcagggccggaagcctagcctatcgtgcgagctctcccggtctccccgtagcagggtgacactgacag

SEQ ID NO: 83455 - DNA, 478 bp, Zea mays
  unsure at all n locations
  Clone ID: LIB3114-058-P1-K1-D5
gcctgccgtaccgaactccccggtgtccgacccaggcgtccgaacttctcaaaattctcaagaggtcaaaagtcagtcgcttcatcatccagaagtcaactctttttggtggttttggtagggcacgagttcaaatattgtattctcctcgtgactatcgagctgaggggacttcatcttcagagttgaaagagatttctgtgaagcaatacacggagatcgttttccaaccactgcgttccaaaaaggctcggaagttcaagctgtccaatgttgtttctgtcacactgagtgcctagcaagcagaagcttgcctttcaaatttaggctagccaagtagccatatctcttgtattttatatttctcgtccgtgtgtgtaactcatcagttgtgtgcttctctgtttgcacttgtaattatgtntctgttcttgatgatgagggaagtaacttacaacgacggctaaaaaaataaaaa

SEQ ID NO: 83456 - DNA, 322 bp, Zea mays
  unsure at all n locations
  Clone ID: LIB3114-058-P1-K1-D8
aataaaaaaaaaatgaaaaaactctcgtagaaataatatacccactataactatgtggtgggggctactccatccgggggctgtgaactgatacaaaaaaggaactgatggataggcatatatagattctacggtcacaacacagttccatgaggggcgcagttaatatgctgttgcagccgcaaaggaagctnnattcagcaaagcttgctcatggatcgggtgtggtcttaatatgtaccaccattattaatctcattacgaccaccacttccatttaggctgaatcttgcaaaatagttgatcgtctggtggtaacatg

SEQ ID NO: 83457 - DNA, 217 bp, Zea mays
  unsure at all n locations
  Clone ID: LIB3114-058-P1-K1-E12
taccggtccgaaattcccggggcgacgccacgcgttcgaaataaatttatatctcaagcgtcctttctataagatccanncttacatacaggggggggcgacctcatagctgggctgtggtgtgacctaaattcaatacactggccgacttaatacaacgtagtgacgtgaggaaaaccttggcgttactcaatttaatctccttgcctcacatccc

SEQ ID NO: 83458 - DNA, 149 bp, Zea mays
  Clone ID: LIB3114-058-P1-K1-E5
gtcgataggcgaggagcataacctcctgagtggggattgttcaaaaacaacgcttgtgggtaagaagcgccaatgttgccacctatgcatcgcgtcgggtatggctgctatttgtttgatattagatgggactagccgaattgctagct

SEQ ID NO: 83459 - DNA, 421 bp, Zea mays
  unsure at all n locations
  Clone ID: LIB3114-058-P1-K1-E9
taaataaaaataataaaaaagtaaatcaattaataaaaaaacaaaaaaaccttccccgggcggggaacaaaaaaacggaggcaaaaaaatcacaaaaaaaaaaataaaataaacaaacattaacaaataataaaacattcaaaaacaccgggcccccccctttataaacccactttccctcccccccccttcctccattttatctttctttagtggcaccccaaatcaattccccttccccactttttccccccctctcctttgaaatccccctcccctcccccccttattttttctcttctctattcccttttccccgctacctgatccaaattaatgccccccccctccccccctccccatttgtttccctcccttaattaacnctcaacccccccctctttcccccccttccccccta

SEQ ID NO: 83460 - DNA, 393 bp, Zea mays
  Clone ID: LIB3114-058-P1-K1-F1
aaggggtcccgcgaaagacaagaagcactagaagaagtgattcgaggtgttggctctcagtggggaatggtagcaatcggtttgagtctcatcaggagacagcgcttgtgggtatgaagcgccaatttgccacctatgcatcgtgttgtgtatggctgctttttgtttgatatttgatgggagtagccgaattgctagctttacccttcatcagcgatgcatacacagcatacggtttttcggtagtgctgtttgattttgatctgtgttgtaagatgtcatgccaagactgtacctgagacactgtttttgataccgatgcagtttggaatttgatggtttttgtgctaaaaaaaaaaaaaaagggcgtgcgttctaaaagatccaagctta

SEQ ID NO: 83461 - DNA, 446 bp, Zea mays
  Clone ID: LIB3114-058-P1-K1-F10
cacgcgtccgaaagaacagcaaagttcccactactatcctaattgaccagggggaggccgacgggttggtggctgagcagcaggggctacctcacaagttcgaggaggcgtgcaaggccgcaggggctgctctgaccttgcgcatgcagcctggatatgaccactcgtactatttcatcgctacgttcgtggacgatcacattgcgcaccatgctcagtttctcaagagcgcctgactgtaaatgtgtagcgtgaggaagacaaggaggcagcctagcatgggtgttttatctatgccgacagtgttgtctcgtgtggcagcttgaggagaggtgaacagcacaccccacatgcgaaataagatggaagatttgctgttcctgtccattgacattgacgagctcgaatgggactgatgttgcaccgaatgtagtttccctgtcatt

SEQ ID NO: 83462 - DNA, 143 bp, Zea mays
  Clone ID: LIB3114-058-P1-K1-F11
aaaaaaaaaaaaaaaaaaaaaaaaaaaaaaaaaaaaaaaaaaaaaaaaaaaaaaggggggggcctatataaaaagaggcgagataacatacacaaacatgcaaacaaaaaagctcttctattgtgccacctaaatttaattgg

SEQ ID NO: 83463 - DNA, 292 bp, Zea mays
  Clone ID: LIB3114-058-P1-K1-F12
cacctcgccgcagcggcgttttccgaggtgttgctgcgttgcgccgggttaacaattttgttgattggtttgttgcgttctctgatcggctaccattctttcgtacgttagttcgttcctgggtcatcgtattttgacctcactctggtagtctggtagcactctggtgcttgcgctctgcgtgcaccactgctgtacaactctaaactacagcctgcaatgcaaggccctactgtaacctgaacctgcatcctgcagttcctcagacaaaatgactgcaggttccgttttg

SEQ ID NO: 83464 - DNA, 239 bp, Zea mays
  Clone ID: LIB3114-058-P1-K1-F6
aaaaaaaaataaataaaaaaaaaaaaaaaaaaaaaaaaaaaaaaaaaaaaaaaaaaattgtgaaatgagaaaagtacggacgatgtagacaacaacataaaaacaaactcacctatatatctacaatttgttttctgttttttaacttccttttatctcactttccttcctttctcctcttttctctccttaaatcttttcacttcccccctttctccaattatctaaattcccatttt

SEQ ID NO: 83465 - DNA, 345 bp, Zea mays
  Clone ID: LIB3114-058-P1-K1-G10
aaaataaaaaaaaaaaaaaaaaaaaaaaaaaaaaatagaaaaaaaaaaaaaaaaacaaaaggaaaaaaaagggtgggggggaaaaaatgatcgagctgccactctttcatacgaaaagaccgatctctggtacatagtattgcgacctcactctggttgtctgggggcactctggtgcttgcgctctgcgtcaccactgctgcacaactctaaactaccccctgcaatgcaaagttatactgtttcctgaacctgcctcttgcagctgctgagacgaaatgcctgcgggccccccctttagacgtccccaacagtggccccccctggcgggcgtttgggacgctc

SEQ ID NO: 83466 - DNA, 144 bp, Zea mays
  Clone ID: LIB3114-058-P1-K1-G2
caggtaccggtcccgaatttccggggggagccacgcttacgcgcacgcgtccgataaaaaatccaaacttacttacacgcgcatgcgacgtcataaggggtggatatagtgtcgcggaggtgttaatccactgccctgttttta

SEQ ID NO: 83467 - DNA, 324 bp, Zea mays
  Clone ID: LIB3114-058-P1-K1-G3
accaggcgttcgaactggagctgtcattctctgtccgtcaggccgccgatccgaacgccgtggcagatatacttaaccggcttttaccgccggaggatccaaccaaccataggtaccatggctggatgatgggaggccagactccagacgttgctgaagaggttcttgcgggcctttgtcccccgaaggattttgtaacactcacaatgaaccgctgctagggttcgtggttccctagctggatgctgatcagacagagtgacaggagtgcttgagctcctgcatgagctttggctccataactgcatccgtttggaatatttt

SEQ ID NO: 83468 - DNA, 87 bp, Zea mays
  Clone ID: LIB3114-058-P1-K1-G4
gtcccgaattcccgggaacaaagcacacgcgtcactaaaaataaaataaaaaaaaaaaaaaaaaaaaaaaaaaaaaaaaaaaaacat

SEQ ID NO: 83469 - DNA, 239 bp, Zea mays
  Clone ID: LIB3114-058-P1-K1-G6
aaaaaaaataaataaaaaaacaaacaaaaaaaaaaaaaaaaaaaaaaaaaacccaatagaggggtaaaaaaaaaacgggtggggggggccccaaattaccaatccacaactcaaaaattaaaaaacattgtcgtccttttttatcttccccctattacacttacattcatttgcaaaccccctcctttccctaactcttacctcttcctcccccctccccttctctacatcctttccca

SEQ ID NO: 83470 - DNA, 320 bp, Zea mays
  Clone ID: LIB3114-058-P1-K1-H10
aaaaaaaaaaaaaaataaaaaaaatataaatttattaatgtaaaaaaaaatttagggtgtgggaaaaaaataaaaataaataagggcagccgttataaaaaaattaatggtttcccccgcgtgcccccctcttttttcccccttctttttccgcccaaatctcttttttgcttctctttccccctttttctgggtccccccgccttcccactttccctttaatctcctccctttctctttttatctttgtgtatttttttttcccctcttttttattggctgtcctttcatttattctttcccccttttttccccctttt

SEQ ID NO: 83471 - DNA, 319 bp, Zea mays
  Clone ID: LIB3114-058-P1-K1-H4
gggaggctcggctggaacggaataaaaccagatcactctttgggtgaacaatggcgggccacctgagcaatatgctggcggtgcaataagtctcctgctgatgtgagcgaaatcacggcttttttctttggtttcatgatgatcctctgcaacttgtgcaaggtagggaatagaaataccgatctcgagattgagggagatgtaagggcgtctgggaacagctcattaacacaatggctacggtgaatgaatcgaatgagcgaggatgtattttgagaacaaccaggcgtcatgaaacgacagtttgttcaataaattt

SEQ ID NO: 83472 - DNA, 191 bp, Zea mays
  Clone ID: LIB3114-058-P1-K1-H9
aactatttatatatcgaaaacaaacaatataaaaaaaaaaaaaattacatactcgagcggtgaaaaaaaataaaaaaaaaaaaggtggggccttcctttgttacaaatgctcgtttctttacattgtcatgacttgtctttcttttttttttaccttaacttaattttcttgcccgcatccttctttatcc

SEQ ID NO: 83473 - DNA, 319 bp, Zea mays
  Clone ID: LIB3114-059-P1-K1-B7
accaacttctccatcgtcttcgttggctcattcgattccttagcttcacatctgcatggcgctgcaccggttactgaagaggaaaggaggcttctatgaacttaacgactatttccctctcgcttctccggcaaccaagattcgccgtctcgacgctgagttgccgtcaattttggaagaggacgaaccgtttcctaacgaggagagagctcttgttctctacaagccttttgttcattccccttcctctttctttctcactctcgattctgaccttatgaaaggaattaggaacaatcaatatctgtggtccaaacaa

SEQ ID NO: 83474 - DNA, 278 bp, Zea mays
  Clone ID: LIB3114-059-P1-K1-B8
aatagttagtcgtcagtcttttatacgggaagagagatcatttgggcacagagacgaaggcttactgcagtgccatcgctagagctgccatcaagtacaagtaggcaaattcgtcaacttagtgtgtcccatgttgcttttcttcaccctccgctgctgtaggctttccggcggcggtcgtttgtgtgggtggcatacctggccaatgcctgtgcgttgcgtgccgctcttgtcccgtgcgtctgtacttgtggatggcgtcttctttttgtgctccc

SEQ ID NO: 83475 - DNA, 199 bp, Zea mays
  Clone ID: LIB3114-059-P1-K1-C1
accacacgtacgtactaagtttattagtattattatcactagctccctgcaatcaaagcatcgcaaatggcttctacagacaagcctggcggcgaccctgaatacagaacatatggaacgccagctcctgctggtgttgatttcctcaaacttgttgtcattcaaaggtttttattgtttgcagcatcactggaagctg

SEQ ID NO: 83476 - DNA, 92 bp, Zea mays
  unsure at all n locations
  Clone ID: LIB3114-059-P1-K1-C6
ccggtccggaattcccgnntcnacctattcttataaattaaatatattatataataaaatttcttataaattcacaatttatttttatttaa

SEQ ID NO: 83477 - DNA, 145 bp, Zea mays
  Clone ID: LIB3114-059-P1-K1-C7
cccacgcgtccggcacaatggtctaccttctacttcttccactaataatcaccatagtggggataaacattgatggattcacctttagcttaaaaccacccaattcctataaaaatgccccggggtcctagcccttttccaatca

SEQ ID NO: 83478 - DNA, 190 bp, Zea mays
  unsure at all n locations
  Clone ID: LIB3114-059-P1-K1-D2
ccgggncgacccacgcgtacgaaaaatacctcaaccactagttatcgcagtacttacactgtttttgtgaacgatgttatgagcattaaaccgaactgaatggatgccctgctcctgttgatcaacttgacttgaatggacggtccggtccctatttgatgtggatgcatgcatgttacaaataggaagc

SEQ ID NO: 83479 - DNA, 356 bp, Zea mays
  Clone ID: LIB3114-059-P1-K1-E1
aaaaaataaataatattatataaaaaaaaaaaattatatataaataaatacaattaaaaagggggtaataattaattgtaaaaatataataataataaaattctatataaataactttataaattaattaatggggggggttgtttttaaagatatctatttatttttcctattgtttatagatttaatctttttttttattgggtacttaatattaaattcttgggccgttttttttaatatgttttttgtaaaaacctgtgggtttcacaattttatctgtttttgaccctttcctttttttcattgttgtttaattatgataaaggtccttaattgattttccttttccaaaa

SEQ ID NO: 83480 - DNA, 322 bp, Zea mays
  Clone ID: LIB3114-059-P1-K1-E12
gcggtaatggaaatatagcccagacatacattttggtgtcctactgtttgatgccttgtacttgtttgcgaactcagctatctaatgggttattggattcttgctcaccttcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggccgttttaaaggacccaagtttacttccccgggcttgcaaagtaatagtttttttttggggcccccaaaattaaattcc

SEQ ID NO: 83481 - DNA, 113 bp, Zea mays
  Clone ID: LIB3114-059-P1-K1-F1
ctagcgtgtgccaaatatgctgtgttcggtatggaatatgaagggactggcccttacgagggagctcgtagctacactatagtgtcacctaacatcatttccctgggcgctga

SEQ ID NO: 83482 - DNA, 329 bp, Zea mays
  Clone ID: LIB3114-059-P1-K1-F4
ccccccccccccaaccccccaccccccaccccgagcaccccacccccccaccaccacccccacccccaccccccacacacgccccctcacgcccccggaacggccccacacacaccacaacccccccaccccacccaacaccacacccacccacaaccccaccccacccccagcacagcaccaccccacccacaccaccccgacaaccaccccccccaccccaccaccccccacccgcccccaccgccccaccccccccccacccccacaccccaacaccccccccaccccacacacccgcccccccgacccccgcccccacccccccc

SEQ ID NO: 83483 - DNA, 263 bp, Zea mays
  Clone ID: LIB3114-059-P1-K1-F7
ctcacgcgtcctttcagattatatatatactccacatctgaagccacaccatcaatctcaacactttccaaattggcctcaccccaaacccctctatcccttctcacaattgcacttctttccctaatccctttcttcatcttcttcctctttaaccgctccaaaggcaaacaacccaaagtaccaccaaccattcccggcgcatggtccatcctcgtgcacctttccctcctagcccgcttctcaaccacccacctccttct

SEQ ID NO: 83484 - DNA, 208 bp, Zea mays
  Clone ID: LIB3114-059-P1-K1-G12
aaaaaaaaaaaaaaaaaaatataaataaaaaatttaaaaaaaaacacaaaaaaaaaaaaaggacaaaaacaaaatcggtgagggcctaattccaaacttacaaccctcatccccttccaatcgtattcctcctaccccctcttcttctccactcaaattactcgcgggcccgccctttatgtccccccagcttccctcccttccgccc

SEQ ID NO: 83485 - DNA, 405 bp, Zea mays
  Clone ID: LIB3114-059-P1-K1-G3
cgcaggacttcaagacggacctccggttccagtcctccgccgtggccgcgctgcaggaggccgccgaggcctacctcgtgggcctcttcgaggacaccaacctctgcgccatccacgccaagcgcgtcaccatcatgcccaaagacatccagctcgcgcgccgcatccggggcgagagggcctgagcacccccggtctctactgcgattccttcgcttcctgatttctgtagcgggaagaactactgtagtaggcgaggaactactgcgtgttatattggggttgtgggtaggaaactaggaatgttctgttggtttctatgcatagtcccttgtgattctgacatccgtgctgcttggtcatggtcttcctactaccgaatggcgattggtacctatttatttt

SEQ ID NO: 83486 - DNA, 151 bp, Zea mays
  unsure at all n locations
  Clone ID: LIB3114-059-P1-K1-G4
agcaggacttcatgacagacctacgtttccagtcctttnccacggccgtgctgcacgaggccgncgagtcctacctcgtgggcctcttcgaggacaccaacctttgtgcgatccacgcagagcgcgttactatcatgctcaaagacatcca

SEQ ID NO: 83487 - DNA, 69 bp, Zea mays
  Clone ID: LIB3114-059-P1-K1-H11
cccacgcgtccgtataaataaaaataaatttatttaaaaaaaaataaaaaaataaaaaaagggaatatt

SEQ ID NO: 83488 - DNA, 96 bp, Zea mays
  unsure at all n locations
  Clone ID: LIB3114-059-P1-K1-H3
atttccggncgacccacgcgttcgaaaaaaaaaaaaaaaaaaaaaaaaaaaaaaaaataataaaataaaaaaaaaaaaaaaaaaatggtaagatat

SEQ ID NO: 83489 - DNA, 57 bp, Zea mays
  unsure at all n locations
  Clone ID: LIB3114-059-P1-K1-H7
anactatctctagatcgctggccgcctatctacaggacccaaccctacgtacgcgtg

SEQ ID NO: 83490 - DNA, 61 bp, Zea mays
  Clone ID: LIB3114-060-P1-K1-A10
caatgcttacaaacgcgggcatccttcttaatagctcttctatagctgcacctaattcaat

SEQ ID NO: 83491 - DNA, 188 bp, Zea mays
  Clone ID: LIB3114-060-P1-K1-A2
aaaaaaaaaaaaaaaaaaaaaaaaaaataaaaaaaaaaaaaaaaaaaaaaaaaaaaaaaaagaaaaaatggcaaattaaaaggggcgcccgctttataggatccatactaacgaacgcgtgcgtgcgacgtcataattattttatggtggcccctaaattcaatgcattgttgtgggtgtcccacttt

SEQ ID NO: 83492 - DNA, 432 bp, Zea mays
  Clone ID: LIB3114-060-P1-K1-A4
aacaaggcaggtatgggcggatctcaagtctgaagacgtgctatttgatcagcacacttatggcgacattgtgagggccttctgtgatgctgatttgattgaccttgcaatggaaatctatgatgacatgaggagctcccccgaccctcctctatcattgccgttccgtgttatcctgaaagggttggttccataccctgaactgagggagaagataaagcaggattttctggagcttttcccagatatgattgtgtatgatccaccagataccttatctgatatagatgaagaattcaagttttgatgaatgtacgccttcatccggattcagtgcttctgagttacattccctgcactgcaggcaaacctccatttcttgttcttttggtgggctagatcaattgtaaatgtagctgtctcgatctgccc

SEQ ID NO: 83493 - DNA, 392 bp, Zea mays
  Clone ID: LIB3114-060-P1-K1-A8
cggatcggaattcccgggtcgacccacgcaaccgaataaaattatttttctagtataagactaagatgatccttgtacatattttggtccgtgggggaattttctccggatgtctgttgtagggaggggaggcagagaaaggttgatttgtatgtggtttcagatgataagaaccccagtggggaggtagaatggaaggccagctaaacacaaaaggatcaaaggagacatggtatgcgaccagaccatgcatgaggtgtctagatgtacatagcgactgtgtagtgcacctgtgtgttgtgtgtgtgtggaggtataacctgcaaaggcgaccattgtttgcgatacaagacctggtaaataaagattaccttggattttttttttatttg

SEQ ID NO: 83494 - DNA, 330 bp, Zea mays
  unsure at all n locations
  Clone ID: LIB3114-060-P1-K1-A9
aaacgcggtgaggaggtcctgaaggccgaggagatggctgccaagtaccgggccaccggccacgctcctaagaagctcatcggttgcttcggagcctaagaaaccttccaagtcagaccgagcagaaagtgaaaaacgtcagccagtgattgcttggtcctctcgctctatcaagtgtgtagtgtgtcttcgaaagtttgtaaagcctactgctgctgctgtatatactgatatcgcttccaaggcaggcgnntggtggtgtacaatgttgaatgcttgacgagaaacattcttgtgtgtagttaagaaggtcacgctgttgttgttgtt

SEQ ID NO: 83495 - DNA, 68 bp, Zea mays
  Clone ID: LIB3114-060-P1-K1-B1
aaaaaaaaaaaaaaaaaaaaaaatataaaaaaaaaaaaaaaaaaaaaaaaaaaaaaaaaaagaaaaaa

SEQ ID NO: 83496 - DNA, 76 bp, Zea mays
  Clone ID: LIB3114-060-P1-K1-B11
cccacgcctccgctcttaatatctgtgagtgtgacagagagtcgcatctatcggaggggctgacgcgtggactgcc

SEQ ID NO: 83497 - DNA, 70 bp, Zea mays
  Clone ID: LIB3114-060-P1-K1-B12
aaaaaaaaaaaaaaaaaataaaataaaaaaaaaaaaaaaaaaaaaaaaaattagaataaaagaaaaaaaa

SEQ ID NO: 83498 - DNA, 431 bp, Zea mays
  unsure at all n locations
  Clone ID: LIB3114-060-P1-K1-B4
acaaaccattgttggacgcgttcccctcctgcacgcaacctcatctcgtcctccagatccaggatggccgtcctccttgagaccttgcctccccgagtgctctcggagagctactttgtttcgatttatcaggaaatccgtttgcttcatgttgtgcaggctcatatctgattgctggattcggcaaacccgcgttggatcctgtatcggttagtccttgcctgcaaggttcttgttgttttgttttggtggncgagcatcgcatgttctgcttctggatccagatctggagaaatcgcgaagtcgtcgtcgttcggttcggagcggatctgaggcgacgatagatggaggcggcgggatctctcggtctgcagtcctgctccacctcgatggatgatgtctctgcgctgataattattggatcaatttcg

SEQ ID NO: 83499 - DNA, 252 bp, Zea mays
  Clone ID: LIB3114-060-P1-K1-B5
aaccaaacaaatgagaaaataggccggaagccccacggcggagtcctctcgttaggtcggcgtgcttagattaggttagctagcttgcctttaataaaaagagagtggtggtcgtcggcgtcggcttcggcggtctgcttcttcttcattcagtgcgtcggtcggtttagagtctgtcacgtgtcccgtcattgaactgcagtttttgttaataaagtattgttattattaggtattattattctcgccctc

SEQ ID NO: 83500 - DNA, 247 bp, Zea mays
  Clone ID: LIB3114-060-P1-K1-C1
ttaatgggacctttttaactttcctcatgcgtccccccaaataaatctactggacggcgaatttaaaacaatggactgggaaaacccttgcagcacccaaactaataaaacctgggcgaaacccaccttaatccgcttgcagaaaaaccaaataggcccggacggattgacattccaaacagccgcccaccctgaccggtaaaaggagacgccctgctgaagggcaaaaagcaccccccctgtagcg

SEQ ID NO: 83501 - DNA, 267 bp, Zea mays
  Clone ID: LIB3114-060-P1-K1-C2
aaaaaaaaaaaaaaaaaaaaaaaaaaaaaaaaaataaaaaaaagaagaaaaaaaaaaaaaagaaaataggaaaataaatataaaaaaaaaaaaaaaactctcagataaaagaaagggggggcgtgatagaagagtaaaagttaatgaagacctcctagctaatgaattatataaagataaaggccacaaaaataaaaatacggggcggaggataaaaaaaatttgtaaatggaaaaaaacatgggtatacccaataaaattaccttt

SEQ ID NO: 83502 - DNA, 384 bp, Zea mays
  unsure at all n locations
  Clone ID: LIB3114-060-P1-K1-C5
cttctgtctttttcggtttcttcttcttctctggttcccgctgcttgtattgtattgtatctagtgtgtatcgtcgtccatccctccggcgggctctgagatgtacctccattcctcctcgtgtacccgtctcgatgcagatgataccggggcatgtgaatgaacagagctggttccgatcaaaaaaaaaaaatatttatatgatatataaaaattagatataatagaaaaaataaaaatattataaaatataaatnnnngtaaggtaagtaaaaattataaaaaaaaaggggnnnnaaaggggggccgttttaaagaaaccaagtttatgtacccgtgcgtgctaggtaataactttttttttggggcccccaaattcaatcc

SEQ ID NO: 83503 - DNA, 57 bp, Zea mays
  unsure at all n locations
  Clone ID: LIB3114-060-P1-K1-C6
ccgaaaaaaaaaaaaaaaanataaaaaaaaaaaaaaagagagcaagaaagagaaaaa

SEQ ID NO: 83504 - DNA, 247 bp, Zea mays
  Clone ID: LIB3114-060-P1-K1-C7
cgagatagaacgaatgtgttcgataatacacttgacgccagactgggggtggtttttcggaagaaattttcagagctccggacgcttctttattgccacaatgctgcttaattgactcaatcctgaaatgatggggtggctaccttttacctagtggggattgccagattgatcctttactgatttcattcccgatgatcaaacttccttcgttgttcataacagggaagaggcccctaccgatcgc

SEQ ID NO: 83505 - DNA, 406 bp, Zea mays
  unsure at all n locations
  Clone ID: LIB3114-060-P1-K1-D11
ttttcagttagttgggatgcaagtttgtcccgtggtctcgctagcattcttcgttctttctggatattgaagagctgttggccatggagcattgtgcaaggtggtaaagtcgattgatggtactacatgaagaaacatgtgcagtacttcagcagtatagatcgtcaggtcagtttagttttttttttcaacaacagtgccatattaggatgttcctgatgtgcgcagttggtctgggtttttacacaacgcaagggtgtcggctgtcgcccgtgcagtttgcgtctttgtgagatctgggtccgtttctgcactccagtacgtggaacaggtttcgcatttggtggccagtgccccaacgtggcgngagtgttgatgatttgaacttggagctgtttgttctatt

SEQ ID NO: 83506 - DNA, 80 bp, Zea mays
  Clone ID: LIB3114-060-P1-K1-D12
aaaaaaaaaaaaaaaaaaaaaaaaaaaaaaaaaaaaaaaaaaaaaaaaaaaaaaaaaaaaaagaaaaaaaaaaaaaaaaa

SEQ ID NO: 83507 - DNA, 255 bp, Zea mays
  Clone ID: LIB3114-060-P1-K1-D2
ggtcttatggagggacatgtttcatccgtgaacagaagttaagagtggtgccggatctacgaatggtttgaattgttttcccgttacaaccacattgtttgctgtgtaagattcactgtacctgccagttggttccatttgttgttttctgtaaaacaaacattaatttgtcactagaatctgtgatgcttgtatgtaaacaggtcctctatttatgtgagccatatatttcattttccgaaataaatatgtata

SEQ ID NO: 83508 - DNA, 376 bp, Zea mays
  unsure at all n locations
  Clone ID: LIB3114-060-P1-K1-D3
aggaatcctatccatccaagccaagccaaggcagataagaagaagaggaggaagaagatgcatctgcagcatgtcggaggggactgccaactgcgtggacatcctgatcgccatcatcctgcctccgctgggggtgttcctcaagcacgggtgcggccacgagttatggatctgcctcctcctcaccttcctcggctacatccccggcatcatctacgccatctacgccatcaccaagaacacctagctagtcatccncaaagacgacgatccatgtctctgtatctgtatctcttaatatgcctgatgccaacttgtgctgtatgtatatacttgaattctctcgagttcctgttttgttaccgtacccacccca

SEQ ID NO: 83509 - DNA, 238 bp, Zea mays
  Clone ID: LIB3114-060-P1-K1-D4
ggatcctattaagtgcattatcaaccaagatatttgaaataatgaactttaggacttggtatgacggtttatgttaagcattgtcaggttttgctattcgtgttatgctgaattgttgtaactcctatatgcagaatattacgtattggttttggttccttcgagaagggcaaatgcaagacgcatctattcccattgagtgaatacaggactaccacatgaagtatttgcttgaaaa

SEQ ID NO: 83510 - DNA, 77 bp, Zea mays
  Clone ID: LIB3114-060-P1-K1-D7
aaaaaaaaaaaaaaaatgcataaaaatgaaccaaaaaataaatcaacgaacatgctaattgcgtcactcttacaata

SEQ ID NO: 83511 - DNA, 111 bp, Zea mays
  unsure at all n locations
  Clone ID: LIB3114-060-P1-K1-D9
aactatanatagaattgatattatacctatcaaaaaaatccatgcttacaaacccgtgcacgccacttcatagcttatatatagagtcaccntacatacaatttagatgat

SEQ ID NO: 83512 - DNA, 55 bp, Zea mays
  Clone ID: LIB3114-060-P1-K1-E2
aaaaaaaaaaaaaaatttaaaaagaaaaaaaaaagaataaagaaaaaaaaaaaaa

SEQ ID NO: 83513 - DNA, 122 bp, Zea mays
  Clone ID: LIB3114-060-P1-K1-E3
aattcccgggtcgacccacccgtccgacctattcaagttgtttaatggtggacccgtggcccaatggtgatcccacttaattttatccgaagggcatattttgggaccaggtaaggctcctg

SEQ ID NO: 83514 - DNA, 59 bp, Zea mays
  Clone ID: LIB3114-060-P1-K1-E5
aaaaaaaaaaaaaaaaaaaaaaaaattaaaaataattaaataaatttataaaaaaataa

SEQ ID NO: 83515 - DNA, 417 bp, Zea mays
  unsure at all n locations
  Clone ID: LIB3114-060-P1-K1-F10
aaaaaaaatacatacaactagctctctaccagcaccagcctggcccgcccttcgctcgccgccgccatggggaggggatagttcaagggaaagcccaccggccgccgcaacttctccacaccggaggagatcgctgctggtacttcangtcgccctcgcacctttaagaagaaggaggaagaggaagaggaggaagaagaatgagaagagtcagaggaggaagaatctgaagacgagtctgttgacagacctagtcctncgggtactgagggtattattcagattgaaatacccaacatagtaaaagtgaaaaaaataaaggcgctaggaagttgatcatgcaaggactactgaactttcaaggccttaaagggaagagctcaaggatcaaaatgctcatgaaccgtttatgaaact

SEQ ID NO: 83516 - DNA, 230 bp, Zea mays
  unsure at all n locations
  Clone ID: LIB3114-060-P1-K1-F3
cccccccccctttnnnntttttttttttttttttttttttaaaaaaaatcgggggacctaaaggcaggctcggaatgggacgattgtaaacatcactaacaacatcagaggagcgggcttgcgaaaaaaaaaaaaaaaaaataaagggggcggccgttttagaggatccaagctaacgtacccgggcatgcgacgtaatagctcttttatagggccacctaaattaaatt

SEQ ID NO: 83517 - DNA, 414 bp, Zea mays
  Clone ID: LIB3114-060-P1-K1-F9
cctccgctccttccagctcgctctctacctgcaccagcctcgcccgcccttcgctcgccgccgccatggggaggggaaagttcaagggaaagcccaccggccgccgcaacttctccacaccggaggagatcgctgctggtacttcaggtcgccctcgcacctttaagaagaaggaggaagaggaagaggaggaagaagaaagagaagagtcagaggaggaagaatctgaagacgagtctgatgacaaacctaaacataaaggtactgagggtattattcagattgaaaatccgaacttagtaaaagtgaagaatataaaggccaaggaagttgatcttggaaagacaactgaactctcaaggcgtgaaagggaggagcttgagaaacaaaaagctcatgaacgttatatgaaac

SEQ ID NO: 83518 - DNA, 313 bp, Zea mays
  Clone ID: LIB3114-060-P1-K1-G6
catctgtttttgctgtcccctacctgagaaatatgaagctgaatctacctcgcacgcggggaatgtatccttttttgctgcaacataaaaaatgctacccaggcatatctgggtaccttttaacttctgtatgtgggatttgctagagtgatggttccgatatatagggggacttgaatgtctggaatgctacggtataacgcacatttgggtgcaatgtctgttgcattgctgtctgaatgacatccatggtacatttattttccagtaacgcctgtagtttgcttatcaacaagcgtggaattgcctgatt

SEQ ID NO: 83519 - DNA, 268 bp, Zea mays
  unsure at all n locations
  Clone ID: LIB3114-060-P1-K1-G8
ctggttggtgggcagatggtgctacggcttccctcaggggtggtgtaagagaagtgcaagctgcagcagaatacaggctcttcacatagtatgagcagaaatctgcaaggatgaatgtctgcacgatttctgaaaacagcaccatatacggccacagaccatagccgagagctgtcagcagacggccacgcgtatccaaaacctgtagaacccagtgggcgcagctaagaaaccttgcaacccccaacgcnaatacatagtgtgctgt

SEQ ID NO: 83520 - DNA, 411 bp, Zea mays
  unsure at all n locations
  Clone ID: LIB3114-060-P1-K1-G9
aacttctacggccagccggcgcgcgacatgcgcctccggtacgtcgagtactacgtctcggaggaggagacgacgctcaaggacaagtacccaagggaccactacgtgttcaaggacccaatgcacatccacgcgcaggggtggccagcgatcgccgagatcatcatgaagcaggatgtcatggtcaacatgacaaggttcaaacccttcttgctccaggcgctcaacgagttgcaggactagctgcanctggagaagggtgattccctttgtatggctcgatacggacagttcggatagggcgataggccagcacagatgcggtacaggagggcctttcgtttgtttcccttttttatttgtcattttaaatcaactaaaattgatatttttaaataaaaaaaggtggct

SEQ ID NO: 83521 - DNA, 105 bp, Zea mays
  Clone ID: LIB3114-060-P1-K1-H5
caaatccttcatttgattagcgcgaccgtttgggtggatggatcgcccttgcagtttgctcggatttgttttgtttgtgatgtaaaaaaaatgatgttctttatc

SEQ ID NO: 83522 - DNA, 177 bp, Zea mays
  Clone ID: LIB3114-060-P1-K1-H6
cccacgcgtccggtgtgagttgtttcggcgggcgtgtgtctgtatgtatggagtcggtggcggaggaggaggtgtgcgcgtggtggtacgtgcgtctacgctccattgtttggggcggcgatcatgtgcctgccccgttttctggttatcaatgagatgatttatttgattctttcc

SEQ ID NO: 83523 - DNA, 243 bp, Zea mays
  unsure at all n locations
  Clone ID: LIB3114-060-P1-K1-H8
aaggcgctgaacatgaccttcccgaagggcggcggtgacgccccgcgggggttccgggagaaacccaggaacgccgagaagccgaccaagtacgccggcagccccaagagcaacgctccccgcgtgatccaccagcctcgctaggttcggtgggggaacgtatcaggaaggctgctgcccctcttgcagccttgctcctggctgccgccgctgtcgtggtctgctctttcaagtcnaagtaac
